US009181587B2

(12) United States Patent
Day et al.

(10) Patent No.: US 9,181,587 B2
(45) Date of Patent: Nov. 10, 2015

(54) METHODS AND NUCLEIC ACIDS FOR THE ANALYSIS OF GENE EXPRESSION ASSOCIATED WITH THE DEVELOPMENT OF PROSTATE CELL PROLIFERATIVE DISORDERS

(75) Inventors: J. Kevin Day, Syracuse, UT (US); Susan Cottrell, Seattle, WA (US); Juergen Distler, Berlin (DE); Andrew Morotti, Seattle, WA (US); Su Yamamura, Bellevue, WA (US); Sharon Dekker, Beaverton, OR (US); Yreka Ocampo, San Marcos, CA (US); Theo Devos, Seattle, WA (US)

(73) Assignee: EPIGENOMICS AG, Berlin (DE)

( * ) Notice: Subject to any disclaimer, the term of this patent is extended or adjusted under 35 U.S.C. 154(b) by 2043 days.

(21) Appl. No.: 10/581,224

(22) PCT Filed: Dec. 1, 2004

(86) PCT No.: PCT/US2004/040289
§ 371 (c)(1),
(2), (4) Date: Nov. 19, 2007

(87) PCT Pub. No.: WO2005/054517
PCT Pub. Date: Jun. 16, 2005

(65) Prior Publication Data
US 2008/0286761 A1    Nov. 20, 2008

(30) Foreign Application Priority Data

Dec. 1, 2003  (EP) .................................. 03090414
Feb. 10, 2004  (EP) .................................. 04090040
May 10, 2004  (EP) .................................. 04090187
Jul. 21, 2004  (EP) .................................. 04090292

(51) Int. Cl.
*C12Q 1/68* (2006.01)

(52) U.S. Cl.
CPC ........ *C12Q 1/6886* (2013.01); *C12Q 2600/112* (2013.01); *C12Q 2600/154* (2013.01); *C12Q 2600/158* (2013.01); *C12Q 2600/16* (2013.01)

(58) Field of Classification Search
None
See application file for complete search history.

(56) References Cited

U.S. PATENT DOCUMENTS

| 5,565,552 | A | 10/1996 | Magda et al. |
| 5,567,810 | A | 10/1996 | Weis et al. |
| 5,574,142 | A | 11/1996 | Meyer, Jr. et al. |
| 5,585,481 | A | 12/1996 | Arnold, Jr. et al. |
| 5,587,371 | A | 12/1996 | Sessler et al. |
| 5,597,696 | A | 1/1997 | Linn et al. |
| 5,786,146 | A | 7/1998 | Herman et al. |
| 5,958,773 | A | 9/1999 | Monia et al. |
| 6,251,594 | B1 | 6/2001 | Gonzalgo et al. |
| 6,265,171 | B1 | 7/2001 | Herman et al. |
| 6,331,393 | B1 | 12/2001 | Laird et al. |
| 7,381,808 | B2 * | 6/2008 | Distler et al. ............... 536/23.1 |
| H0002220 | H * | 7/2008 | Wang ............................ 536/23.1 |
| 2001/0053519 | A1 * | 12/2001 | Fodor et al. ..................... 435/6 |
| 2003/0013091 | A1 | 1/2003 | Dimitrov |
| 2004/0241651 | A1 | 12/2004 | Olek et al. |

FOREIGN PATENT DOCUMENTS

| CA | 2435917 A1 | 9/2002 |
| EP | 03090414.8 | 12/2003 |
| EP | 04090040.9 | 2/2004 |
| EP | 04090187.8 | 5/2004 |
| EP | 04090292.6 | 7/2004 |
| WO | WO 95/00669 | 1/1995 |
| WO | WO 95/15373 | 6/1995 |
| WO | WO 97/46705 | 12/1997 |
| WO | 99/00405 A1 | 1/1999 |
| WO | WO 99/28498 | 6/1999 |
| WO | WO 99/55905 | 11/1999 |
| WO | WO 00/26401 | 5/2000 |
| WO | WO 01/76451 | 10/2001 |
| WO | WO 02/00926 | 1/2002 |
| WO | WO 02/18632 | 3/2002 |
| WO | 02/072880 A2 | 9/2002 |
| WO | WO 02/081749 | 10/2002 |
| WO | WO 02/103041 | 12/2002 |
| WO | WO 02/103042 | 12/2002 |
| WO | WO02103042 | * 12/2002 ............... C12Q 1/68 |
| WO | WO 03/044232 | 5/2003 |
| WO | WO 2004/000463 | 12/2003 |

OTHER PUBLICATIONS

Buck et al. (Biotechniques, 1999, 27, p. 528-536.*
Belyavsky et al., "PCR-based cCNA library construction: general cDNA libraries at the level of a few calls," Nucleic Acids Research, 1989, pp. 2919-2932, vol. 17, No. 8.
Bowtell, "Options available—from start to finish—for obtaining expression data by microarray," Nature Genetics Supplement, Jan. 1999, pp. 25-32, vol. 21.
Cairns et al., "Molecular Detection of Prostate Cancer in Urine by GSTP1 Hypermethylation," Clinical Cancer Research, Sep. 2001, pp. 2727-2730, vol. 7.
Database, EMBL, Human Genomic Sequence, Apr. 30, 2002, Database Accession No. AC063960, XP002338678, abstract.
Database, EMBL, Human EST, Dec. 22, 1999, Database Accession No. AI702131, XP002338879, abstract.
Database, EMBL, Human EST, May 24, 2000, Database Accession No. AW853489, XP002338680, abstract.
Database, EMBL, Human EST, Dec. 1, 2000, Database Accession No. BF432721, XP002338681, abstract.

(Continued)

*Primary Examiner* — Stephanie K Mummert
(74) *Attorney, Agent, or Firm* — Lathrop & Gage LLP; James H. Velema, Esq.

(57) ABSTRACT

The following application provides methods and nucleic acids for the detection of and/or differentiation between prostate cell proliferative disorders. This is achieved by the analysis of the expression status of a panel of genes, or subsets thereof.

20 Claims, 8 Drawing Sheets

(56) References Cited

OTHER PUBLICATIONS

Database, EMBL, Human EST, Mar. 22, 2003, Database Accession No. BX374481, XP002338682, abstract.

Eads et al., "CpG Island Hypermethylation in Human Colorectal Tumors is Not Associated with DNA Methyltransferase Overexpression," Cancer Research, May 15, 1999, pp. 2302-2308, vol. 59.

Feil et al., "Methylation analysis on individual chromosomes: improved protocol for bisulphite genomic sequencing," Nucleic Acids Research, 1994, pp. 695-696, vol. 22, No. 4.

Frommer et al., "A genomic sequencing protocol that yields a positive display of 5-methylcylosine residues in individual DNA strands," PNAS, Mar. 1992, pp. 1827-1831, vol. 89.

Galfre et al., "Preparation of Monoclonal Antibodies: Strategies and Procedures," Methods in Enzymology, pp. 3-46, vol. 73.

Gonzalgo et al., "Identification and Characterization of Differentially Methylated Regions of Genomic DNA by Methylation-sensitve Arbitrarily Primed PCR," Cancer Research, Feb. 15, 1997, pp. 594-599, vol. 57.

Gonzalgo et al., Rapid quantitation of methylation differences at specific sites using methylation-sensitive single nucleotide primer extension (Ms-SNuPE), Nucleic Acids Research, 1997, pp. 2529-2531, vol. 25, No. 12.

Grigg et al., "Sequencing 5-Methylcytosine Residues in Genomic DNA," BioEssays, Jun. 1994, pp. 431-436, vol. 16, No. 6.

Gut et al, "DNA and Matrix Assisted Laser Desorption Ionization Mass Spectrometry," Molecular Biology: Current Innovations and Future Trends, 1995, pp. 147-157, Horizon Scientific Press, Wymondham, United Kingdom.

Gut et al., "A procedure for selection DNA alkylation and detection by mass spectrometry," Nucleic Acids Research, 1995, pp. 1367-1373, vol. 23, No. 8.

Harden et al., "Quantitative GSTP1 Methylation and the Detection of Prostate Adenocarcinoma in Sextant Biopsies," Journal of the National Cancer Institute, Nov. 5, 2003, pp. 1634-1637, vol. 95, No. 21.

Heid et al., "Real Time Quantitative PCR," Genome Research, 1996, pp. 986-994, vol. 6.

Herman et al., "Methylation-specific PCR: A novel PCR assay for methylation status of CpG islands," Sep. 1996, pp. 9821-9826, vol. 93.

Karas et al., "Laser Desorption Ionization of Proteins with Molecular Masses Exceeding 10 000 Daltons," Analytical Chemistry, Oct. 15, 1988, pp. 2299-2301, vol. 60, No. 20.

Koehler et al., "Continuous cultures of fused cells secreting antibody of predefined specificity," Nature, Aug. 7, 1975, pp. 495-497, vol. 256.

Krug et al., "First-Strand cDNA Synthesis Primed with Oligo(dT)," Methods in Enzymology, 1987, pp. 316-325, vol. 152.

Lipshutz et al., "High density synthetic oligonucleotide arrays," Nature Genetics Supplement, Jan. 1999, pp. 20-24, vol. 21.

Martin et al., "Genomic sequencing indicates a correlation between DNA hypomethylation in the 5' region of the pS2 gene and its expression in human breast cancer cell lines," Gene, 1995, pp. 261-265, vol. 157.

Olek et al., "A modified and improved method for bisulphite based cytosine methylation analysis," Nucleic Acids Research, 1998, pp. 5064-5066, vol. 24, No. 24.

Olek et al., "The pre-implantation ontogeny of the H19 methylation imprint," Nature Genetics, Nov. 1997, pp. 275-276, vol. 17.

Rein et al., "Identifying 5-methylcytosine and related modifications in DNA genomes," Nucleic Acids Research, 1998, pp. 2255-2284, vol. 26, No. 10.

Sadri et al., "Rapid analysis of DNA methylation using new restriction enzyme sites created by bisulfite modification," Nucleic Acids Research, 1996, pp. 5058-5059, vol. 24, No. 24.

Sanger et al., "DNA sequencing with chain-terminating inhibitors," PNAS, Dec. 1977, pp. 5463-5467, vol. 74, No. 12.

Santourlidis et al., "High Frequency of Alterations in DNA Methylation in Adenocarcinoma of the Prostate," The Prostate, 1999, pp. 166-174, vol. 39.

Stites et al., "Clinical Laboratory Methods for Detection of Antigens and Antibodies," *Basic and Clinical Immunology*, 7$^{th}$ ed., 1991, pp. 217-262, Appleton & Lange, Norwalk, Conn.

Toyota et al., "Identification of Differentially Methylated Sequences in Colorectal Cancer by Methylated CpG Island Amplification," Cancer Research, May 15, 1999, pp. 2307-2312, vol. 59.

Van Der Krol et al., "Modulation of Eukaryotic Gene Expression by Complementary RNA or DNA Sequences," BioTechniques, Nov.-Dec. 1988, pp. 958-976, vol. 6, No. 10.

Vis et al., "Feasibility of Assessment of Promoter Methylation of the CD44 Gene in Serum of Prostate Cancer Patients," Molecular Urology, 2001, pp. 199-203, vol. 5, No. 4.

Xiong et al., "COBRA: a sensitive and quantitative DNA methylation assay," Nucleic Acids Research, 1997, pp. 2532-2534, vol. 25, No. 12.

Yamada et al., "Aberrant methylation of the vascular endothelial growth factor receptor-1 gene in prostate cancer," Cancer Science, Jun. 2003, pp. 536-539, vol. 94, No. 6.

Yu et al., "Specific Inhibition of PCR by Non-Extendable Oligonudeotides Using a 5' to 3' Exonuclease-Deficient DNA Polymerase," BioTechniques, Oct. 1997, pp. 714-720, vol. 23.

Zeschnigk et al., "Imprinted segments in the human genome: different DNA methylation pattersn in the Prader-Willi/Angelman syndrome region as determined by the genomic sequencing method," Human Molecular Genetics, 1997, pp. 387-395, vol. 6, No. 3.

Zeschnigk et al., "A single-tube PCR test for the diagnosis of Angelman and Prader-Willi syndrome based on allelic methylation differences at the SNRPN locus," European Journal of Human Genetics, Mar.-Apr. 1997, pp. 94-98, vol. 5, No. 2.

Zon, "Oligonudeotide Analogues as Potential Chemotherapeutic Agents" Pharmaceutical Research, Sep. 1988, pp. 539-549, vol. 5, No. 9.

\* cited by examiner

Figure 1

METHODS AND NUCLEIC ACIDS FOR THE ANALYSIS OF GENE EXPRESSION ASSOCIATED WITH THE DEVELOPMENT OF PROSTATE CELL PROLIFERATIVE DISORDERS

CROSS-REFERENCE TO RELATED APPLICATIONS

This application claims the benefit of priority to the following applications: European application number 03090414.8, filed 1 Dec. 2003; European application number 04090040.9, filed 10 Feb. 2004; European application number 04090187.8, filed 10 May 2004; and European application number 04090292.6, filed 21 Jul. 2004; all of which are incorporated by reference herein in their entireties.

FIELD OF THE INVENTION

The present invention relates to human DNA sequences that exhibit altered heterogenous expression patterns in prostate cancer patients. Particular embodiments of the invention provide methods for the diagnosis of individuals with said disorder.

SEQUENCE LISTING

A Sequence Listing, pursuant to 37 C.F.R. §1.52(e)(5), has been provided on compact disc (1 of 1) as a 1.64 MB text file, entitled "47675-95 Sequence Listing.txt," and which is incorporated by reference herein in its entirety.

BACKGROUND

Correlation of aberrant DNA methylation with cancer. Aberrant DNA methylation within CpG 'islands' is characterized by hyper- or hypomethylation of CpG dinucleotide sequences leading to abrogation or over expression of a broad spectrum of genes, and is among the earliest and most common alterations found in, and correlated with human malignancies. Additionally, abnormal methylation has been shown to occur in CpG-rich regulatory elements in both intronic and coding parts of genes for certain tumors. In colon cancer, aberrant DNA methylation constitutes one of the most prominent alterations and inactivates many tumor suppressor genes including, inter alia, p14ARF, p16INK4a, THBS1, MIT2, and MINT31 and DNA mismatch repair genes such as hMLH1.

Aside from the specific hypermethylation of tumor suppressor genes, an overall hypomethylation of DNA can be observed in tumor cells. This decrease in global methylation can be detected early, far before the development of frank tumor formation. A correlation between hypomethylation and increased gene expression has been determined for many oncogenes.

Prostate cancer. Prostate cancer is the most common malignancy among men in the United States (~200,000 new cases per year), and the sixth leading cause of male cancer-related deaths worldwide (~204,000 per year). Prostate cancer is primarily a disease of the elderly, with approximately 16% of men between the ages of 60 and 79 having the disease. According to some estimates at autopsy, 80% of all men over 80 years of age have some form of prostate disease (eg cancer, BPH, prostatitis, etc). Benign prostate hypertrophy is present in about 50% of men aged 50 or above, and in 95% of men aged 75 or above. It is obvious from these reports that prostate cancer is often not a disease that men die from, but with. Recent evidence suggests that the incidence of prostate cancer may in fact be declining, likely as result of better treatment, better surgery, and earlier detection.

Diagnosis of prostate cancer; molecular approaches. Current guidelines for prostate cancer screening have been suggested by the American Cancer Society and are as follows: At 50 years of age, health care professionals should offer a blood test for prostate specific antigen (PSA) and perform a digital rectal exam (DRE). It is recommended that high risk populations, such as African Americans and those with a family history of prostate disease, should begin screening at 45 years of age. Men without abnormal prostate pathology generally have a PSA level in blood below 4 ng/ml. PSA levels between 4 ng/ml and 10 ng/ml (called the 'grey zone') have a 25% chance of having prostate cancer. The result is that 75% of the time, men with an abnormal DRE and a PSA in this grey zone have a negative, or a seemingly unnecessary biopsy. Above the grey zone, the likelihood of having prostate cancer is significant (>67%) and increases even further as PSA levels go up. Numerous methods exist for measuring PSA (percent-free PSA, PSA velocity, PSA density, etc.), and each has an associated accuracy for detecting the presence of cancer. Yet, even with the minor improvements in detection, and the reported drops in mortality associated with screening, the frequency of false positives remains high. Reduced specificity results in part from increased blood PSA associated with BPH, and prostatis. It has also been estimated that up to 45% of prostate biopsies under currrent guidelines are falsely negative, resulting in decreased sensitivity even with biopsy.

TRUS guided biopsy is considered the 'gold standard' for diagnosing prostate cancer. Recommendations for biopsy are based upon abnormal PSA levels and/or an abnormal DRE. For PSA, there is a grey zone where a high percentage of biopsies are perhaps not necessary. Yet the ability to detect cancer in this grey zone (PSA levels of 4.0 to 10 ng/ml) is difficult without biopsy. Due to this lack of specificity, 75% of men undergoing a biopsy do not have cancer. Yet without biopsy, those with cancer would be missed, resulting in increased morbidity and mortality. Unfortunately, the risks associated with an unecessary biopsy are also high.

Molecular markers would offer the advantage that they can be used to efficiently analyze even very small tissue samples, and samples whose tissue architecture has not been maintained. Within the last decade, numerous genes have been studied with respect to differential expression among benign hyperplasia of the prostate and different grades of prostate cancer. However, no single marker has as yet been shown to be sufficient for the detection of prostate tumors in a clinical setting.

Alternatively, high-dimensional mRNA-based approaches may, in particular instances, provide a means to distinguish between different tumor types and benign and malignant lesions. However, application of such approaches as a routine diagnostic tool in a clinical environment is impeded and substantially limited by the extreme instability of MRNA, the rapidly occurring expression changes following certain triggers (e.g., sample collection), and, most importantly, by the large amount of mRNA needed for analysis which often cannot be obtained from a routine biopsy (see, e.g., Lipshutz, R. J. et al., *Nature Genetics* 21:20-24, 1999; Bowtell, D. D. L. *Nature Genetics Suppl.* 21:25-32, 1999).

Aberrant genetic methylation in prostate cancer has been observed in several genes including Gstp1, AR, p16 (CDKN2a/INK4a), CD44, CDH1. Genome-wide hypomethylation for example of the LINE-1 repetitive element has also been associated with tumor progression (Santourlidis, S., et al., *Prostate* 39:166-74, 1999).

Prostate cancer methylation markers. The core promoter region of the Gluthione S-Transferase P gene (GSTP1; accession no. NM_000852) has been shown to be hypermethylated in prostate tumor tissue. The glutathione S-transferase pi enzyme is involved in the detoxification of electrophilic carcinogens, and impaired or decreased levels of enzymatic activity (GSTP1 impairment) have been associated with the development of neoplasms, particularly in the prostate. Mechanisms of GSTP1 impairment include mutation (the GSTP*B allele has been associated with a higher risk of cancer) and methylation. However, with respect to the use of Gstp1 markers, the prior art is limited with respect to the number of Gstp1 promoter CpG sequences that have been characterized for differential methylation status. Moreover, there are no disclosures, suggestions or teachings in the prior art of how such markers could be used to distinguish among benign hyperplasia of the prostate and different grades of prostate cancer.

Aberrant genetic methylation has also been observed in several other genes including AR, p16 (CDKN2a/INK4a), CD44, CDH1. Genome-wide hypomethylation, for example, of the LINE-1 repetitive element has also been associated with tumor progression (Santourlidis, S., et al., *Prostate* 39:166-74, 1999).

However, use of these genes as alternative or supplemental diagnostically or otherwise clinically useful markers in a commercial setting has not been enabled. The application of differentially methylated genes to clinically utilizable platforms requires much further investigation into the sensitivity and specificity of the genes. For example, in the case of the gene CD44, a known metastasis suppressor, downregulation was associated with hypermethylation. However the use of this gene as a commercially avalable marker was not enabled, because it was also methylated in normal tissues (see Vis, et al., *Mol Urol.* 5:199-203, 2001).

Development of medical tests. Two key evaluative measures of any medical screening or diagnostic test are its sensitivity and specificity, which measure how well the test performs to accurately detect all affected individuals without exception, and without falsely including individuals who do not have the target disease (predictive value). Historically, many diagnostic tests have been criticized due to poor sensitivity and specificity. A true positive (TP) result is where the test is positive and the condition is present. A false positive (FP) result is where the test is positive but the condition is not present. A true negative (TN) result is where the test is negative and the condition is not present. A false negative (FN) result is where the test is negative but the condition is not present.

In this context: Sensitivity=$TP/(TP+FN)$;
Specificity=$TN/(FP+TN)$; and Predictive
value=$TP/(TP+FP)$.

Sensitivity is a measure of a test's ability to correctly detect the target disease in an individual being tested. A test having poor sensitivity produces a high rate of false negatives, i.e., individuals who have the disease but are falsely identified as being free of that particular disease. The potential danger of a false negative is that the diseased individual will remain undiagnosed and untreated for some period of time, during which the disease may progress to a later stage wherein treatments, if any, may be less effective. An example of a test that has low sensitivity is a protein-based blood test for HIV. This type of test exhibits poor sensitivity because it fails to detect the presence of the virus until the disease is well established and the virus has invaded the bloodstream in substantial numbers. In contrast, an example of a test that has high sensitivity is viral-load detection using the polymerase chain reaction (PCR). High sensitivity is achieved because this type of test can detect very small quantities of the virus. High sensitivity is particularly important when the consequences of missing a diagnosis are high.

Specificity, on the other hand, is a measure of a test's ability to identify accurately patients who are free of the disease state. A test having poor specificity produces a high rate of false positives, i.e., individuals who are falsely identified as having the disease. A drawback of false positives is that they force patients to undergo unnecessary medical procedures treatments with their attendant risks, emotional and financial stresses, and which could have adverse effects on the patient's health. A feature of diseases which makes it difficult to develop diagnostic tests with high specificity is that disease mechanisms, particularly in cancer, often involve a plurality of genes and proteins. Additionally, certain proteins may be elevated for reasons unrelated to a disease state. An example of a test that has high specificity is a gene-based test that can detect a p53 mutation. Specificity is important when the cost or risk associated with further diagnostic procedures or further medical intervention are very high.

The PSA blood test has a sensitivity of 73%, specificity of 60% and predictive value of 31.5%. PSA sensitivity and specificity can be improved but involve tradeoffs. PSA sensitivity can be improved by adjusting the "normal" PSA level to a lower value for younger men or by following serum PSA values in an individual patient over time (PSA velocity). Both methods will increase the number of cancers detected, but they also increase the number of men undergoing biopsy. Conversely, specificity can be improved by using higher "normal" PSA levels for older men, by using the free-to-total PSA ratio, or by adjusting the normal value according to the size of the prostate. These three methods decrease the number of unnecessary biopsies, but they increase the risk that some cancers will be missed.

It can therefore be seen that there exists a need for a means of prostate cancer diagnosis with improved sensitivity, specificity and/or predictive value.

Sensitivity and specificity of quantitative methylation-specific polymerase chain reaction (QMSP) assay alone (without histological analysis) in prostate cancer analysis of needle biopsies has ranged from 30% sensitivity and 100% specificity to 89% sensitivity and 64% specificity (Harden et. al. J Natl Cancer Inst 2003; 95: 1634-1637). However the predictive value of said technique as a clinical screening tool was not analysed. Furthermore, genetic testing of serum and bodily fluids such as urine and saliva would reduce the need for biopsies to detect cancer and would thus be the most effective screening or monitering tool. However the development of such tests requires an extremely high degree of sensitivity and specificity. Analysis of Gstp1 gene hypermethylation (Cairns P, et al. *Clin Cancer Res* 7:2727-30 2001.) in urine sediment of prostate cancer patients showed that only 6 out of 22 individuals with elevated methylation levels in biopsied tumors showed corresponding hypermethylation in urine samples.

Multifactorial approach. Cancer diagnostics has traditionally relied upon the detection of single molecular markers (e.g. gene mutations, elevated PSA levels). Unfortunately, cancer is a disease state in which single markers have typically failed to detect or differentiate many forms of the disease. Thus, assays that recognize only a single marker have been shown to be of limited predictive value. A fundamental aspect of this invention is that methylation based cancer diagnostics and the screening, diagnosis, and therapeutic monitoring of such diseases will provide significant improvements over the state-of-the-art that uses single marker analyses by the use of a selection of multiple markers. The multiplexed analytical approach is particularly well suited for cancer diagnostics since cancer is not a simple disease, this multi-factorial "panel" approach is consistent with the heterogeneous nature of cancer, both cytologically and clinically.

Pronounced need in the art. Therefore, in view of the incidence of prostate hyperplasia (50% of men aged 50 or above, and 95% of men aged 75 or above) and prostate cancer (180 per 100,000), there is a substantial need in the art for the development of molecular markers that could be used to provide sensitive, accurate and non-invasive methods (as opposed to, e.g., biopsy and transrectal ultrasound) for the screening of populations to provide an early diagnosis of prostate cell proliferative disorders.

SUMMARY OF THE INVENTION

The present invention provides novel methods and nucleic acids for the detection of and/or differentiation between prostate cell proliferative disorders. The invention thereby addresses the longfelt need for novel means for the early diagnosis of prostate cell proliferative disorders, in particular for the detection of prostate cancer, prostate carcinoma and prostate neoplasms.

The invention solves this longstanding need in the art by providing a panel of genes, genomic sequences and/or regulatory regions thereof according to Table 26, the expression levels thereof being indicative of the presence of prostate cell proliferative disorders or features thereof. In particular the methylation status of CpG positions thereof are indicative of the presence of prostate cell proliferative disorders or features thereof. Preferred selections and combinations of genes are provided, the methylation analysis of which enable the detection of prostate cell proliferative disorders.

Wherein the method is for the diagnosis of prostate cell proliferative disorders; (most preferably prostate cancer, prostate carcinoma and/or neoplasms) it is preferred that said genes and/or sequences are selected from the group consisting of SEQ ID NO: 1023, GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID) NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027.

Wherein the method is for the diagnosis of prostate cell proliferative disorders, (most preferably prostate cancer, prostate carcinoma and/or neoplasms) it is also preferred that said genes and/or sequences are Gstp1 and one or more sequences selected from the group consisting of SEQ ID NO: 1017 to SEQ ID NO: 1028. Wherein the method is for the diagnosis of prostate cell proliferative disorders, (most preferably prostate cancer, prostate carcinoma and/or neoplasms) it is particularly preferred that Gstp1 and SEQ ID NO: 1023 are analysed.

Wherein the method is for the diagnosis of prostate cancer, prostate carcinoma and/or neoplasms and or differentiation thereof from benign prostate hyperplasia it is particularly preferred that SEQ ID NO: 1023 is analysed. It is also preferred that SEQ ID NO: 1023 and one or more genes and/or sequences selected from Table 26 are analysed. It is also preferred that SEQ ID NO: 1023 and one or more genes and/or sequences selected from the group consisting GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027 are analysed.

Particularly preferred are the combinations of genes described in Tables 22 and 23, in particular the analysis of SEQ ID NO: 1023 and GSTP1.

Wherein the method is for the differentiation of one of normal prostate and/or BPH from prostate cancer it is particularly preferred that the target sequence(s) comprise, or hybridizes under stringent conditions to, one or more more sequences comprising at least 16 contiguous nucleotides of the sequences according to Table 4, said contiguous nucleotides comprising at least one CpG, TpG or CpA dinucleotide sequence.

Wherein the method is for the differentiation of one of normal prostate, normal tissue from other tissues, cancer of other tissues and/or BPH from prostate cancer it is particularly preferred that the target sequence(s) comprise, or hybridizes under stringent conditions to, one or more more sequences comprising at least 16 contiguous nucleotides of the sequences according to Table 5, said contiguous nucleotides comprising at least one CpG, TpG or CpA dinucleotide sequence.

Wherein the method is for the differentiation of prostate cancer from cancers of other tissues it is particularly preferred that the target sequence(s) comprise, or hybridizes under stringent conditions to, one or more more sequences comprising at least 16 contiguous nucleotides of the sequences according to Table 6, said contiguous nucleotides comprising at least one CpG, TpG or CpA dinucleotide sequence.

It is particularly preferred that said prostate cell proliferative disorder is a prostate cancer, prostate carcinoma or prostate neoplasm. In further embodiments the invention provides methods and nucleic acids for the differentiation between non-cancerous types of prostate tissue (including BPH and normal) from prostate carcinoma. In further embodiments the invention provides methods and nucleic acids for the differentiation of prostate cancer from normal prostate tissue, tissues originating from other tissues and BPH. In further embodiments the invention provides methods and nucleic acids for the differentiation of prostate cancer form cancers originating from other tissues.

In order to enable this analysis the invention provides a method for the analysis of biological samples for genomic methylation associated with the development of prostate cell proliferative disorders. Said method is characterised in that at least one nucleic acid, or a fragment thereof, from the group consisting of SEQ ID NO: 1 to SEQ ID NO: 59, SEQ ID NO: 1017 to SEQ ID NO: 1028, SEQ ID NO: 1116 and SEQ ID NO:1171 is/are contacted with a reagent or series of reagents capable of distinguishing between methylated and non methylated CpG dinucleotides within the genomic sequence, or sequences of interest. It is further preferred that at least one nucleic acid, or a fragment thereof, from the group consisting of SEQ ID NO: 1023, SEQ ID NO: 57, SEQ ID NO: 20, SEQ ID NO: 36, SEQ ID NO: 1171, SEQ ID NO: 51, SEQ ID NO: 31, SEQ ID NO: 24, SEQ ID NO: 11, SEQ ID NO: 1028, SEQ ID NO: 4, SEQ ID NO: 1116, SEQ ID NO: 1025, SEQ ID NO: 1020, SEQ ID NO: 18, SEQ ID NO: 1019 and SEQ ID NO: 1027 is/are contacted with a reagent or series of reagents capable of distinguishing between methylated and non methylated CpG dinucleotides within the genomic sequence, or sequences of interest.

It is particularly preferred that the method and nucleic acids according to the invention are utilised for at least one of: detection of; screening of populations for; differentiation between; monitoring of; and detection and monitoring of prostate cell proliferative disorders.

The present invention provides a method for ascertain genetic and/or epigenetic parameters of genomic DNA. The method has utility for the improved detection of and/or differentiation between prostate cell proliferative disorders. The invention presents several improvements over the state of the art. Although methylation assays for the detection of prostate cancer are known there is currently no molecular classification system for the detection of prostate cell proliferative disorders, nor one that accurately differentiates benign conditions from prostate carcinomas and neoplasms.

The source may be any suitable source. Preferably, the source of the DNA sample is selected from the group consisting of cells or cell lines, histological slides, biopsies, paraffin-embedded tissue, bodily fluids, ejaculate, urine, blood, and combinations thereof. Preferably, the source is biopsies, bodily fluids, ejaculate, urine, or blood.

Specifically, the present invention provides a method for the detection of prostate cell proliferative disorders, comprising: obtaining a biological sample comprising genomic nucleic acid(s); contacting the nucleic acid(s), or a fragment thereof, with one reagent or a plurality of reagents sufficient for distinguishing between methylated and non methylated CpG dinucleotide sequences within a target sequence of the subject nucleic acid, wherein the target sequence comprises, or hybridizes under stringent conditions to, a sequence comprising at least 16 contiguous nucleotides of SEQ ID NO: 1 to SEQ ID NO: 59, SEQ ID NO: 1017 to SEQ ID NO: 1028, SEQ ID NO: 1116 and SEQ ID NO:1171, said contiguous nucleotides comprising at least one CpG dinucleotide sequence; and determining, based at least in part on said distinguishing, the methylation state of at least one target CpG dinucleotide sequence, or an average, or a value reflecting an average methylation state of a plurality of target CpG dinucleotide sequences.

It is particularly preferred that the target sequence comprises, or hybridizes under stringent conditions to, a sequence comprising at least 16 contiguous nucleotides of SEQ ID NO: 1023, SEQ ID NO: 57, SEQ ID NO: 20, SEQ ID NO: 36, SEQ ID NO: 1171, SEQ ID NO: 51, SEQ ID NO: 31, SEQ ID NO: 24, SEQ ID NO: 11, SEQ ID NO: 1028, SEQ ID NO: 4, SEQ ID NO: 1116, SEQ ID NO: 1025, SEQ ID NO: 1020, SEQ ID NO: 18, SEQ ID NO: 1019 and SEQ ID NO: 1027 said contiguous nucleotides comprising at least one CpG dinucleotide sequence; and determining, based at least in part on said distinguishing, the methylation state of at least one target CpG dinucleotide sequence, or an average, or a value reflecting an average methylation state of a plurality of target CpG dinucleotide sequences.

Preferably, distinguishing between methylated and non methylated CpG dinucleotide sequences within the target sequence comprises methylation state-dependent conversion or non-conversion of at least one such CpG dinucleotide sequence to the corresponding converted or non-converted dinucleotide sequence within a sequence selected from the group consisting of SEQ ID NOs: 60-295, 1029-1076, 1117-1120, 1172-1175, and contiguous regions thereof corresponding to the target sequence.

Additional embodiments provide a method for the detection of and/or differentiation between prostate cell proliferative disorders, comprising: obtaining a biological sample having subject genomic DNA; extracting the genomic DNA; treating the genomic DNA, or a fragment thereof, with one or more reagents to convert 5-position unmethylated cytosine bases to uracil or to another base that is detectably dissimilar to cytosine in terms of hybridization properties; contacting the treated genomic DNA, or the treated fragment thereof, with an amplification enzyme and at least two primers comprising, in each case a contiguous sequence at least 9 nucleotides in length that is complementary to, or hybridizes under moderately stringent or stringent conditions to a sequence selected from the group consisting SEQ ID NOs: 60-295, 1029-1076, 1117-1120, 1172-1175, and complements thereof, wherein the treated DNA or the fragment thereof is either amplified to produce an amplificate, or is not amplified; and determining, based on a presence or absence of, or on a property of said amplificate, the methylation state of at least one CpG dinucleotide sequence selected from the group consisting of SEQ ID NO: 1 to SEQ ID NO: 59, SEQ ID NO: 1017 to SEQ ID NO: 1028, SEQ ID NO: 1116 and SEQ ID NO: 1171, or an average, or a value reflecting an average methylation state of a plurality of CpG dinucleotide sequences thereof. Preferably, at least one such hybridizing nucleic acid molecule or peptide nucleic acid molecule is bound to a solid phase. Preferably, determining comprises use of at least one method selected from the group consisting of: hybridizing at least one nucleic acid molecule comprising a contiguous sequence at least 9 nucleotides in length that is complementary to, or hybridizes under moderately stringent or stringent conditions to a sequence selected from the group consisting of SEQ ID NOs: 60-295, 1029-1076, 1117-1120, 1172-1175, and complements thereof; hybridizing at least one nucleic acid molecule, bound to a solid phase, comprising a contiguous sequence at least 9 nucleotides in length that is complementary to, or hybridizes under moderately stringent or stringent conditions to a sequence selected from the group consisting of SEQ ID NOs: 60-295, 1029-1076, 1117-1120, 1172-1175, and complements thereof; hybridizing at least one nucleic acid molecule comprising a contiguous sequence at least 9 nucleotides in length that is complementary to, or hybridizes under moderately stringent or stringent conditions to a sequence selected from the group consisting of SEQ ID NOs: 60-295, 1029-1076, 1117-1120, 1172-1175, and complements thereof, and extending at least one such hybridized nucleic acid molecule by at least one nucleotide base; and sequencing of the amplificate.

Further embodiments provide a method for the detection of and/or differentiation between prostate cell proliferative disorders, comprising: obtaining a biological sample having subject genomic DNA; extracting the genomic DNA; contacting the genomic DNA, or a fragment thereof, comprising one or more sequences selected from the group consisting of SEQ ID NO: 1 to SEQ ID NO: 59, SEQ ID NO: 1017 to SEQ ID NO: 1028, SEQ ID NO: 1116 and SEQ ID NO: 1171 or a sequence that hybridizes under stringent conditions thereto, with one or more methylation-sensitive restriction enzymes, wherein the genomic DNA is either digested thereby to produce digestion fragments, or is not digested thereby; and determining, based on a presence or absence of, or on property of at least one such fragment, the methylation state of at least one CpG dinucleotide sequence of one or more sequences selected from the group consisting of SEQ ID NO: 1 to SEQ ID NO: 59, SEQ ID NO: 1017 to SEQ ID NO: 1028, SEQ ID NO: 1116 and SEQ ID NO: 1171, or an average, or a value reflecting an average methylation state of a plurality of CpG dinucleotide sequences thereof. Preferably, the digested or undigested genomic DNA is amplified prior to said determining.

Additional embodiments provide novel genomic and chemically modified nucleic acid sequences, as well as oligonucleotides and/or PNA-oligomers for analysis of cytosine methylation patterns within sequences from the group consisting of SEQ ID NO: 1 to SEQ ID NO: 59, SEQ ID NO: 1017 to SEQ ID NO: 1028, SEQ ID NO: 1116 and SEQ ID NO:1171.

BRIEF DESCRIPTION OF THE DRAWINGS

FIGS. 1 to 3 show ranked matrices produced from bisulfite sequencing data. The overall matrix represents the sequencing data for one fragment. Each row of the matrix represents a single CpG site within the fragment and each column represents an individual sample. The bar on the left represents a scale of the percent of methylation, with the degree of methylation represented by the shade of each position within the column from black representing 100% methylation to light grey representing 0% methylation. No data was available at white positions.

FIG. 1 shows the sequencing data of a fragment of the gene Prostaglandin E2 Receptor, EP4 Subtype wherein the sequenced samples are from prostate carcinoma.

FIG. 2 shows the sequencing data of a fragment of the gene Orphan Nuclear Receptor (a-1Fetoprotein Transcription Factor wherein the sequenced samples are from prostate carcinoma.

FIG. 3 shows the sequencing data of a fragment of the gene 1-Acyl-SN-Glycerol-3-Phosphate Acyltransferase Gamma wherein the sequenced samples are from prostate carcinoma.

DETAILED DESCRIPTION OF THE INVENTION

Definitions

Figure 2:
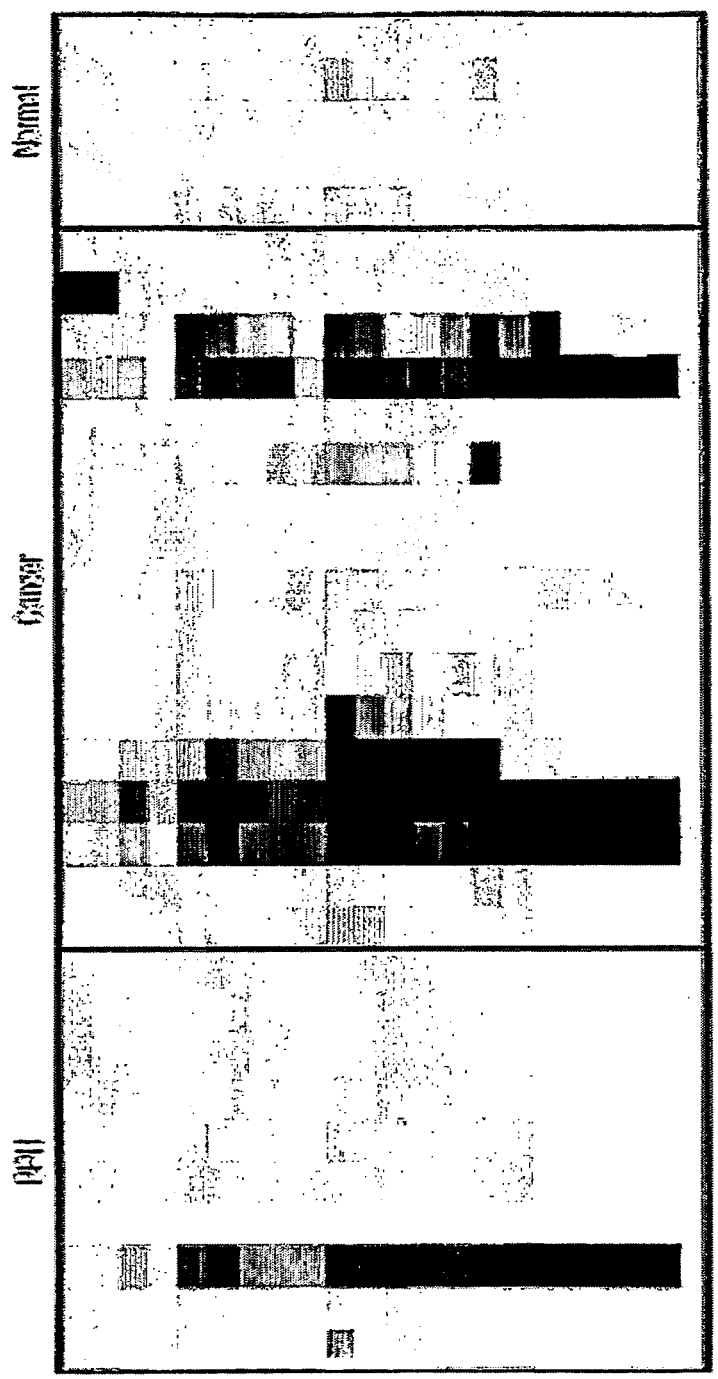
Figure 2:
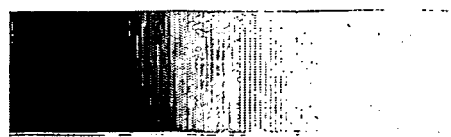

As used herein the term expression shall be taken to mean the transcription and translation of a gene. The level of expression of a gene may be determined by the analysis of any factors associated with or indicative of the level of transcription and translation of a gene including but not limited to methylation analysis, loss of heterozygosity (hereinafter also referred to as LOH), RNA expression levels and protein expression levels.

Furthermore the activity of the transcribed gene may be affected by genetic variations such as but not limited genetic mutations (including but not limited to SNPs, point mutations, deletions, insertions, repeat length, rearrangements and other polymorphisms).

The term "Observed/Expected Ratio" ("O/E Ratio") refers to the frequency of CpG dinucleotides within a particular DNA sequence, and corresponds to the [number of CpG sites/(number of C bases×number of G bases)].

The term "CpG island" refers to a contiguous region of genomic DNA that satisfies the criteria of (1) having a frequency of CpG dinucleotides corresponding to an "Observed/Expected Ratio" >0.6, and (2) having a "GC Content" >0.5. CpG islands are typically, but not always, between about 0.2 to about 1 kb, or to about 2 kb in length.

The term "methylation state" or "methylation status" refers to the presence or absence of 5-methylcytosine ("5-mCyt") at one or a plurality of CpG dinucleotides within a DNA sequence. Methylation states at one or more particular CpG methylation sites (each having two CpG CpG dinucleotide sequences) within a DNA sequence include "unmethylated," "fully-methylated" and "hemi-methylated."

The term "hemi-methylation" or "hemimethylation" refers to the methylation state of a palindromic CpG methylation site, where only a single cytosine in one of the two CpG dinucleotide sequences of the palindromic CpG methylation site is methylated (e.g. 5'-CC$^M$GG-3' (top strand): 3'-GGCC-5' (bottom strand)).

The term 'AUC' as used herein is an abbreviation for the area under a curve. In particular it refers to the area under a Receiver Operating Characteristic (ROC) curve. The ROC curve is a plot of the true positive rate against the false positive rate for the different possible cutpoints of a diagnostic test. It shows the tradeoff between sensitivity and specificity depending on the selected cutpoint (any increase in sensitivity will be accompanied by a decrease in specificity). The area under an ROC curve (AUC) is a measure for the accuracy of a diagnostic test (the larger the area the better, optimum is 1, a random test would have a ROC curve lying on the diagonal with an area of 0.5; for reference: J. P. Egan. Signal Detection Theory and ROC Analysis, Academic Press, New York, 1975).

The term "hypermethylation" refers to the average methylation state corresponding to an increased presence of 5-mCyt at one or a plurality of CpG dinucleotides within a DNA sequence of a test DNA sample, relative to the amount of 5-mCyt found at corresponding CpG dinucleotides within a normal control DNA sample.

The term "hypomethylation" refers to the average methylation state corresponding to a decreased presence of 5-mCyt at one or a plurality of CpG dinucleotides within a DNA sequence of a test DNA sample, relative to the amount of 5-mCyt found at corresponding CpG dinucleotides within a normal control DNA sample.

The term "microarray" refers broadly to both "DNA microarrays," and 'DNA chip(s),' as recognized in the art, encompasses all art-recognized solid supports, and encompasses all methods for affixing nucleic acid molecules thereto or synthesis of nucleic acids thereon.

"Genetic parameters" are mutations and polymorphisms of genes and sequences further required for their regulation. To be designated as mutations are, in particular, insertions, deletions, point mutations, inversions and polymorphisms and, particularly preferred, SNPs (single nucleotide polymorphisms).

"Epigenetic parameters" are, in particular, cytosine methylations. Further epigenetic parameters include, for example, the acetylation of histones which, however, cannot be directly analyzed using the described method but which, in turn, correlate with the DNA methylation.

The term "bisulfite reagent" refers to a reagent comprising bisulfite, disulfite, hydrogen sulfite or combinations thereof, useful as disclosed herein to distinguish between methylated and unmethylated CpG dinucleotide sequences.

The term "Methylation assay" refers to any assay for determining the methylation state of one or more CpG dinucleotide sequences within a sequence of DNA.

The term "MS.AP-PCR" (Methylation-Sensitive Arbitrarily-Primed Polymerase Chain Reaction) refers to the art-recognized technology that allows for a global scan of the genome using CG-rich primers to focus on the regions most likely to contain CpG dinucleotides, and described by Gonzalgo et al., *Cancer Research* 57:594-599, 1997.

The term "MethyLight™" refers to the art-recognized fluorescence-based real-time PCR technique described by Eads et al., *Cancer Res.* 59:2302-2306, 1999.

The term "HeavyMethyl™" assay, in the embodiment thereof implemented herein, refers to an assay, wherein methylation specific blocking probes (also referred to herein as blockers) covering CpG positions between, or covered by the amplification primers enable methylation-specific selective amplification of a nucleic acid sample.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers.

The term "Ms-SNuPE" (Methylation-sensitive Single Nucleotide Primer Extension) refers to the art-recognized assay described by Gonzalgo & Jones, *Nucleic Acids Res.* 25:2529-2531, 1997.

The term "MSP" (Methylation-specific PCR) refers to the art-recognized methylation assay described by Herman et al. *Proc. Natl. Acad. Sci. USA* 93:9821-9826, 1996, and by U.S. Pat. No. 5,786,146.

The term "COBRA" (Combined Bisulfite Restriction Analysis) refers to the art-recognized methylation assay described by Xiong & Laird, *Nucleic Acids Res.* 25:2532-2534, 1997.

The term "MCA" (Methylated CpG Island Amplification) refers to the methylation assay described by Toyota et al., *Cancer Res.* 59:2307-12, 1999, and in WO 00/26401A1.

The term "hybridization" is to be understood as a bond of an oligonucleotide to a complementary sequence along the lines of the Watson-Crick base pairings in the sample DNA, forming a duplex structure.

"Stringent hybridization conditions," as defined herein, involve hybridizing at 68° C. in 5×SSC/5×Denhardt's solution/1.0% SDS, and washing in 0.2×SSC/0.1% SDS at room temperature, or involve the art-recognized equivalent thereof (e.g., conditions in which a hybridization is carried out at 60° C. in 2.5×SSC buffer, followed by several washing steps at 37° C. in a low buffer concentration, and remains stable). Moderately stringent conditions, as defined herein, involve including washing in 3×SSC at 42° C., or the art-recognized equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley & Sons, N.Y.) at Unit 2.10.

The terms "array SEQ ID NO," "composite array SEQ ID NO," or "composite array sequence" refer to a sequence, hypothetical or otherwise, consisting of a head-to-tail (5' to 3') linear composite of all individual contiguous sequences of a subject array (e.g., a head-to-tail composite of SEQ ID NO:1-71, in that order).

The terms "array SEQ ID NO node," "composite array SEQ ID NO node," or "composite array sequence node" refer to a junction between any two individual contiguous sequences of the "array SEQ ID NO," the "composite array SEQ ID NO," or the "composite array sequence."

In reference to composite array sequences, the phrase "contiguous nucleotides" refers to a contiguous sequence region of any individual contiguous sequence of the composite array, but does not include a region of the composite array sequence that includes a "node," as defined herein above.

Overview

The present invention provides molecular genetic markers that have novel utility for the detection of and/or differentiation between prostate cell proliferative disorders. It is particularly preferred that the method and nucleic acids according to the invention are utilised for at least one of: detection of; screening of populations for; differentiation between; monitoring of; and detection and monitoring of prostate cell proliferative disorders.

Bisulfite modification of DNA is an art-recognized tool used to assess CpG methylation status. 5-methylcytosine is the most frequent covalent base modification in the DNA of eukaryotic cells. It plays a role, for example, in the regulation of the transcription, in genetic imprinting, and in tumorigenesis. Therefore, the identification of 5-methylcytosine as a component of genetic information is of considerable interest. However, 5-methylcytosine positions cannot be identified by sequencing, because 5-methylcytosine has the same base pairing behavior as cytosine. Moreover, the epigenetic information carried by 5-methylcytosine is completely lost during, e.g., PCR amplification.

The most frequently used method for analyzing DNA for the presence of 5-methylcytosine is based upon the specific reaction of bisulfite with cytosine whereby, upon subsequent alkaline hydrolysis, cytosine is converted to uracil which corresponds to thymine in its base pairing behavior. Significantly, however, 5-methylcytosine remains unmodified under these conditions. Consequently, the original DNA is converted in such a manner that methylcytosine, which originally could not be distinguished from cytosine by its hybridization behavior, can now be detected as the only remaining cytosine using standard, art-recognized molecular biological techniques, for example, by amplification and hybridization, or by sequencing. All of these techniques are based on differential base pairing properties, which can now be fully exploited.

The prior art, in terms of sensitivity, is defined by a method comprising enclosing the DNA to be analyzed in an agarose matrix, thereby preventing the diffusion and renaturation of the DNA (bisulfite only reacts with single-stranded DNA), and replacing all precipitation and purification steps with fast dialysis (Olek A, et al., A modified and improved method for bisulfite based cytosine methylation analysis, *Nucleic Acids Res.* 24:5064-6, 1996). It is thus possible to analyze individual cells for methylation status, illustrating the utility and sensitivity of the method. An overview of art-recognized methods for detecting 5-methylcytosine is provided by Rein, T., et al., *Nucleic Acids Res.*, 26: 2255, 1998.

The bisulfite technique, barring few exceptions (e.g., Zeschnigk M, et al., *Eur J Hum Genet.* 5:94-98, 1997), is currently only used in research. In all instances, short, specific fragments of a known gene are amplified subsequent to a bisulfite treatment, and either completely sequenced (Olek & Walter, *Nat Genet.* 1997 17:275-6, 1997), subjected to one or more primer extension reactions (Gonzalgo & Jones, *Nucleic Acids Res.*, 25:2529-31, 1997; WO 95/00669; U.S. Pat. No. 6,251,594) to analyze individual cytosine positions, or treated by enzymatic digestion (Xiong & Laird, *Nucleic Acids Res.*, 25:2532-4, 1997). Detection by hybridization has also been described in the art (Olek et al., WO 99/28498). Additionally, use of the bisulfite technique for methylation detection with respect to individual genes has been described (Grigg & Clark, *Bioessays,* 16:431-6, 1994; Zeschnigk M, et al., *Hum Mol Genet.*, 6:387-95, 1997; Feil R, et al., *Nucleic Acids Res.*, 22:695-, 1994; Martin V, et al., *Gene,* 157:261-4, 1995; WO 9746705 and WO 9515373).

In one aspect, the present invention provides for the use of the bisulfite technique, in combination with one or more methylation assays, for determination of the methylation status of CpG dinucleotide sequences within sequences from the group consisting of SEQ ID NO: 1 to SEQ ID NO: 59, SEQ ID NO: 1017 to SEQ ID NO: 1028, SEQ ID NO: 1116 and SEQ ID NO:1171.

According to the present invention, determination of the methylation status of CpG dinucleotide sequences within sequences from the group consisting of SEQ ID NO: 1 to SEQ ID NO: 59, SEQ ID NO: 1017 to SEQ ID NO: 1028, SEQ ID NO: 1116 and SEQ ID NO: 1171 has utility for the detection of and/or differentiation between prostate cell proliferative disorders.

Methylation Assay Procedures. Various methylation assay procedures are known in the art, and can be used in conjunction with the present invention. These assays allow for determination of the methylation state of one or a plurality of CpG dinucleotides (e.g., CpG islands) within a DNA sequence. Such assays involve, among other techniques, DNA sequencing of bisulfite-treated DNA, PCR (for sequence-specific amplification), Southern blot analysis, and use of methylation-sensitive restriction enzymes.

For example, genomic sequencing has been simplified for analysis of DNA methylation patterns and 5-methylcytosine distribution by using bisulfite treatment (Frommer et al., *Proc. Natl. Acad. Sci. USA* 89:1827-1831, 1992). Additionally, restriction enzyme digestion of PCR products amplified from bisulfite-converted DNA is used, e.g., the method described by Sadri & Hornsby (*Nucl. Acids Res.* 24:5058-5059, 1996), or COBRA (Combined Bisulfite Restriction Analysis) (Xiong & Laird, *Nucleic Acids Res.* 25:2532-2534, 1997). COBRA. COBRA analysis is a quantitative methylation assay useful for determining DNA methylation levels at specific gene loci in small amounts of genomic DNA (xiong & Laird, *Nucleic Acids Res.* 25:2532-2534, 1997). Briefly, restriction enzyme digestion is used to reveal methylation-dependent sequence differences in PCR products of sodium bisulfite-treated DNA. Methylation-dependent sequence differences are first introduced into the genomic DNA by standard bisulfite treatment according to the procedure described by Frommer et al. (*Proc. Natl. Acad. Sci. USA* 89:1827-1831, 1992). PCR amplification of the bisulfite converted DNA is then performed using primers specific for the CpG islands of interest, followed by restriction endonuclease digestion, gel electrophoresis, and detection using specific, labeled hybridization probes. Methylation levels in the original DNA sample are represented by the relative amounts of digested and undigested PCR product in a linearly quantitative fashion across a wide spectrum of DNA methylation levels. In addition, this technique can be reliably applied to DNA obtained from microdissected paraffin-embedded tissue samples. Typical reagents (e.g., as might be found in a typical COBRA-based kit) for COBRA analysis may include, but are not limited to: PCR primers for specific gene (or bisulfite treated DNA sequence or CpG island); restriction enzyme and appropriate buffer; gene-hybridization oligo; control hybridization oligo; kinase labeling kit for oligo probe; and labelled nucleotides. Additionally, bisulfite conversion reagents may include: DNA denaturation buffer; sulfonation buffer; DNA recovery reagents or kits (e.g., precipitation, ultrafiltration, affinity column); desulfonation buffer; and DNA recovery components.

Preferably, assays such as "MethyLight™" (a fluorescence-based real-time PCR technique) (Eads et al., *Cancer Res.* 59:2302-2306, 1999), Ms-SNuPE (Methylation-sensitive Single Nucleotide Primer Extension) reactions (Gonzalgo & Jones, *Nucleic Acids Res.* 25:2529-2531, 1997), methylation-specific PCR ("MSP"; Herman et al., *Proc. Natl. Acad. Sci. USA* 93:9821-9826, 1996; U.S. Pat. No. 5,786,146), and methylated CpG island amplification ("MCA"; Toyota et al., Cancer Res. 59:2307-12, 1999) are used alone or in combination with other of these methods.

MethyLight™. The MethyLight™ assay is a high-throughput quantitative methylation assay that utilizes fluorescence-based real-time PCR (TaqMan™) technology that requires no further manipulations after the PCR step (Eads et al., Cancer Res. 59:2302-2306, 1999). Briefly, the MethyLight™ process begins with a mixed sample of genomic DNA that is converted, in a sodium bisulfite reaction, to a mixed pool of methylation-dependent sequence differences according to standard procedures (the bisulfite process converts unmethylated cytosine residues to uracil). Fluorescence-based PCR is then performed either in an "unbiased" (with primers that do not overlap known CpG methylation sites) PCR reaction, or in a "biased" (with PCR primers that overlap known CpG dinucleotides) reaction. Sequence discrimination can occur either at the level of the amplification process or at the level of the fluorescence detection process, or both.

The MethyLight™ assay may be used as a quantitative test for methylation patterns in the genomic DNA sample, wherein sequence discrimination occurs at the level of probe hybridization. In this quantitative version, the PCR reaction provides for unbiased amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the "MSP" technique), or with oligonucleotides covering potential methylation sites.

The MethyLight™ process can by used with a "TaqMan®" probe in the amplification process. For example, double-stranded genomic DNA is treated with sodium bisulfite and subjected to one of two sets of PCR reactions using TaqMan® probes; e.g., with either biased primers and TaqMan® probe, or unbiased primers and TaqMan® probe. The TaqMan® probe is dual-labeled with fluorescent "reporter" and "quencher" molecules, and is designed to be specific for a relatively high GC content region so that it melts out at about 10° C. higher temperature in the PCR cycle than the forward or reverse primers. This allows the TaqMan® probe to remain fully hybridized during the PCR annealing/extension step. As the Taq polymerase enzymatically synthesizes a new strand during PCR, it will eventually reach the annealed TaqMan® probe. The Taq polymerase 5' to 3' endonuclease activity will then displace the TaqMan® probe by digesting it to release the fluorescent reporter molecule for quantitative detection of its now unquenched signal using a real-time fluorescent detection system.

Typical reagents (e.g., as might be found in a typical MethyLight™-based kit) for MethyLight™ analysis may include, but are not limited to: PCR primers for specific gene (or bisulfite treated DNA sequence or CpG island); TaqMan® probes; optimized PCR buffers and deoxynucleotides; and Taq polymerase.

Ms-SNuPE. The Ms-SNuPE technique is a quantitative method for assessing methylation differences at specific CpG sites based on bisulfite treatment of DNA, followed by single-nucleotide primer extension (Gonzalgo & Jones, Nucleic Acids Res. 25:2529-2531, 1997). Briefly, genomic DNA is reacted with sodium bisulfite to convert unmethylated cytosine to uracil while leaving 5-methylcytosine unchanged. Amplification of the desired target sequence is then performed using PCR primers specific for bisulfite-converted DNA, and the resulting product is isolated and used as a template for methylation analysis at the CpG site(s) of interest. Small amounts of DNA can be analyzed (e.g., microdissected pathology sections), and it avoids utilization of restriction enzymes for determining the methylation status at CpG sites.

Typical reagents (e.g., as might be found in a typical Ms-SNuPE-based kit) for Ms-SNuPE analysis may include, but are not limited to: PCR primers for specific gene (or bisulfite treated DNA sequence or CpG island); optimized PCR buffers and deoxynucleotides; gel extraction kit; positive control primers; Ms-SNuPE primers for specific gene; reaction buffer (for the Ms-SNuPE reaction); and labelled nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

MSP. MSP (methylation-specific PCR) allows for assessing the methylation status of virtually any group of CpG sites within a CpG island, independent of the use of methylation-sensitive restriction enzymes (Herman et al. Proc. Natl. Acad. Sci. USA 93:9821-9826, 1996; U.S. Pat. No. 5,786,146). Briefly, DNA is modified by sodium bisulfite converting all unmethylated, but not methylated cytosines to uracil, and subsequently amplified with primers specific for methylated versus unmethylated DNA. MSP requires only small quantities of DNA, is sensitive to 0.1% methylated alleles of a given CpG island locus, and can be performed on DNA extracted from paraffin-embedded samples. Typical reagents (e.g., as might be found in a typical MSP-based kit) for MSP analysis may include, but are not limited to: methylated and unmethylated PCR primers for specific gene (or bisulfite treated DNA sequence or CpG island), optimized PCR buffers and deoxynucleotides, and specific probes.

MCA. The MCA technique is a method that can be used to screen for altered methylation patterns in genomic DNA, and to isolate specific sequences associated with these changes (Toyota et al., Cancer Res. 59:2307-12, 1999). Briefly, restriction enzymes with different sensitivities to cytosine methylation in their recognition sites are used to digest genomic DNAs from primary tumors, cell lines, and normal tissues prior to arbitrarily primed PCR amplification. Fragments that show differential methylation are cloned and sequenced after resolving the PCR products on high-resolution polyacrylamide gels. The cloned fragments are then used as probes for Southern analysis to confirm differential methylation of these regions. Typical reagents (e.g., as might be found in a typical MCA-based kit) for MCA analysis may include, but are not limited to: PCR primers for arbitrary priming Genomic DNA; PCR buffers and nucleotides, restriction enzymes and appropriate buffers; gene-hybridization oligos or probes; control hybridization oligos or probes.

//
//
//
//
GENOMIC SEQUENCES ACCORDING TO SEQ ID NO: 1 TO SEQ ID NO: 59, SEQ ID NO: 1017 TO SEQ ID NO: 1028, SEQ ID NO: 1116 AND SEQ ID NO: 1171, AND NON-NATURALLY OCCURING TREATED VARIANTS THEREOF ACCORDING TO SEQ ID NOS: 60-295, 1029-1076, 1117-1120, 1172-1175 WERE DETERMINED TO HAVE UTILITY FOR THE DETECTION, CLASSIFICATION AND/OR MONITORING OF PROSTATE CELL PROLIFERATIVE DISORDERS.

In one embodiment the invention provides a method for the detection of and/or differentiation between prostate cell proliferative disorders in a subject. Said method comprises the following steps i) determining the expression levels of one or more genes or gene sequences according to Table 26 and/or regulatory regions thereof ii) determining the presence or absence of a prostate cell proliferative disorders according to said level of expression.

Wherein the method is for the diagnosis of prostate cell proliferative disorders, (most preferably prostate cancer, prostate carcinoma and/or neoplasms) it is preferred that said genes and/or sequences are selected from the group consisting of SEQ ID NO: 1023, GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027.

Wherein the method is for the diagnosis of prostate cell proliferative disorders, (most preferably prostate cancer, prostate carcinoma and/or neoplasms) it is also preferred that said genes and/or sequences are Gstp1 and one or more sequences selected from the group consisting of SEQ ID NO: 1017 to SEQ ID NO: 1028. Wherein the method is for the diagnosis of prostate cell proliferative disorders, (most preferably prostate cancer, prostate carcinoma and/or neoplasms) it is particularly preferred that Gstp1 and SEQ ID NO: 1023 are analysed.

Wherein the method is for the diagnosis of prostate cancer, prostate carcinoma and/or neoplasms and or differentiation thereof from benign prostate hyperplasia it is particularly preferred that SEQ ID NO: 1023 is analysed. It is also preferred that SEQ ID NO: 1023 and one or more genes and/or sequences selected from Table 26 are analysed.

It is also preferred that SEQ ID NO: 1023 and one or more genes and/or sequences selected from the group consisting GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027 are analysed.

Particularly preferred are the combinations of genes described in Tables 22 and 23, in particular the analysis of SEQ ID NO: 1023 and GSTP1.

Wherein the method is for the differentiation of one of normal prostate and/or BPH from prostate cancer it is particularly preferred that the target sequence(s) comprise, or hybridizes under stringent conditions to, one or more sequences comprising at least 16 contiguous nucleotides of the sequences according to Table 4, said contiguous nucleotides comprising at least one CpG, TpG or CpA dinucleotide sequence.

Wherein the method is for the differentiation of one of normal prostate, normal tissue from other tissues, cancer of other tissues and/or BPH from prostate cancer it is particularly preferred that the target sequence(s) comprise, or hybridizes under stringent conditions to, one or more sequences comprising at least 16 contiguous nucleotides of the sequences according to Table 5, said contiguous nucleotides comprising at least one CpG, TpG or CpA dinucleotide sequence.

Wherein the method is for the differentiation of prostate cancer from cancers of other tissues it is particularly preferred that the target sequence(s) comprise, or hybridizes under stringent conditions to, one or more more sequences comprising at least 16 contiguous nucleotides of the sequences according to Table 6, said contiguous nucleotides comprising at least one CpG, TpG or CpA dinucleotide sequence.

Said expression level may be determined by any means standard in the art including but not limited to methylation analysis, loss of heterozygosity (hereinafter also referred to as LOH), RNA expression levels and protein expression levels.

Said use of the genes and/or sequences may be enabled by means of any analysis of the expression of the gene, by means of mRNA expression analysis or protein expression analysis. However, in the most preferred embodiment of the invention, the detection of and/or differentiation between prostate cell proliferative disorders is enabled by means of analysis of the methylation status of said genes or genomic sequences and their promoter or regulatory elements. Methods for the methylation analysis of genes are described herein.

In one embodiment the method discloses the use of one or more genes or genomic sequences selected from the group consisting the genes according to Table 26 as markers for the detection of and/or differentiation between prostate cell proliferative disorders.

Wherein the method is for the diagnosis of prostate cell proliferative disorders, (most preferably prostate cancer, prostate carcinoma and/or neoplasms) it is preferred that said genes and/or sequences are selected from the group consisting of SEQ ID NO: 1023, GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027.

Wherein the method is for the diagnosis of prostate cell proliferative disorders, (most preferably prostate cancer, prostate carcinoma and/or neoplasms) it is also preferred that said genes and/or sequences are Gstp1 and one or more sequences selected from the group consisting of SEQ ID NO: 1017 to SEQ ID NO: 1028. Wherein the method is for the diagnosis of prostate cell proliferative disorders, (most preferably prostate cancer, prostate carcinoma and/or neoplasms) it is particularly preferred that Gstp1 and SEQ ID NO: 1023 are analysed.

Wherein the method is for the diagnosis of prostate cancer, prostate carcinoma and/or neoplasms and or differentiation thereof from benign prostate hyperplasia it is particularly preferred that SEQ ID NO: 1023 is analysed. It is also preferred that SEQ ID NO: 1023 and one or more genes and/or sequences selected from Table 26 are analysed.

It is also preferred that SEQ ID NO: 1023 and one or more genes and/or sequences selected from the group consisting GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027 are analysed.

Particularly preferred are the combinations of genes described in Tables 22 and 23, in particular the analysis of SEQ ID NO: 1023 and GSTP1.

Wherein the method is for the differentiation of one of normal prostate and/or BPH from prostate cancer it is particularly preferred that the target sequence(s) comprise, or hybridizes under stringent conditions to, one or more more sequences comprising at least 16 contiguous nucleotides of the sequences according to Table 4, said contiguous nucleotides comprising at least one CpG, TpG or CpA dinucleotide sequence.

Wherein the method is for the differentiation of one of normal prostate, normal tissue from other tissues, cancer of other tissues and/or BPH from prostate cancer it is particularly preferred that the target sequence(s) comprise, or hybridizes under stringent conditions to, one or more more sequences comprising at least 16 contiguous nucleotides of the sequences according to Table 5, said contiguous nucleotides comprising at least one CpG, TpG or CpA dinucleotide sequence.

Wherein the method is for the differentiation of prostate cancer from cancers of other tissues it is particularly preferred that the target sequence(s) comprise, or hybridizes under stringent conditions to, one or more more sequences comprising at least 16 contiguous nucleotides of the sequences according to Table 6, said contiguous nucleotides comprising at least one CpG, TpG or CpA dinucleotide sequence.

Said use of the genes and/or sequences may be enabled by means of any analysis of the expression of the gene, by means of mRNA expression analysis or protein expression analysis. However, in the most preferred embodiment of the invention, the detection of and/or differentiation between prostate cell proliferative disorders is enabled by means of analysis of the methylation status of said genes or genomic sequences and their promoter or regulatory elements. Methods for the methylation analysis of genes are described herein.

Aberrant levels of mRNA expression of the genes, genomic sequences or genes regulated by genomic sequences according to Table 26 are associated with presence of prostate cell proliferative disorders. Accordingly, increased or decreased levels of expression of said genes or sequences are associable with factors associated with the presence of prostate cell proliferative disorders; and are indicative of subtypes thereof.

To detect the presence of mRNA encoding a gene or genomic sequence in a detection of and/or differentiation between prostate cell proliferative disorders, a sample is obtained from a patient. Preferably, the source of the DNA sample is selected from the group consisting of cells or cell lines, histological slides, biopsies, paraffin-embedded tissue, bodily fluids, ejaculate, urine, blood, and combinations thereof. Preferably, the source is biopsies, bodily fluids, ejaculate, urine, or blood. The sample may be treated to extract the nucleic acids contained therein. The resulting nucleic acid from the sample is subjected to gel electrophoresis or other separation techniques. Detection involves contacting the nucleic acids and in particular the mRNA of the sample with a DNA sequence serving as a probe to form hybrid duplexes. The stringency of hybridisation is determined by a number of factors during hybridisation and during the washing procedure, including temperature, ionic strength, length of time and concentration of formamide. These factors are outlined in, for example, Sambrook et al. molecular Cloning: A Laboratory Manual, 2d ed., 1989). Detection of the resulting duplex is usually accomplished by the use of labelled probes. Alternatively, the probe may be unlabeled, but may be detectable by specific binding with a ligand which is labelled, either directly or indirectly. Suitable labels and methods for labelling probes and ligands are known in the art, and include, for example, radioactive labels which may be incorporated by known methods (e.g., nick translation or kinasing), biotin, fluorescent groups, chemiluminescent groups (e.g., dioxetanes, particularly triggered dioxetanes), enzymes, antibodies, and the like.

In order to increase the sensitivity of the detection in a sample of mRNA transcribed from the gene or genomic sequence, the technique of reverse transcription/polymerisation chain reaction can be used to amplify cDNA transcribed from the mRNA. The method of reverse transcription/PCR is well known in the art (for example, see Watson and Fleming, supra).

The reverse transcription/PCR method can be performed as follows. Total cellular RNA is isolated by, for example, the standard guanidium isothiocyanate method and the total RNA is reverse transcribed. The reverse transcription method involves synthesis of DNA on a template of RNA using a reverse transcriptase enzyme and a 3' end primer. Typically, the primer contains an oligo(dT) sequence. The cDNA thus produced is then amplified using the PCR method and EYA4 specific primers. (Belyavsky et al, Nucl Acid Res 17:2919-2932, 1989; Krug and Berger, Methods in Enzymology, Academic Press, N.Y., Vol. 152, pp. 316-325, 1987 which are incorporated by reference)

Aberrant levels of polypeptide expression of the polypeptides encoded by the genes, genomic sequences or genes regulated by genomic sequences of the group consisting all genes and genomic sequences of genomic regions listed in Table 26 are associated with the detection of and/or differentiation between prostate cell proliferative disorders. Accordingly over or under expression of said polypeptides are associable with the presence of prostate carcinoma, prostate neoplasms and other prostate cell proliferative disorders.

Wherein the method is for the diagnosis of prostate cell proliferative disorders, (most preferably prostate cancer, prostate carcinoma and/or neoplasms) it is preferred that said genes and/or sequences are selected from the group consisting of SEQ ID NO: 1023, GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027.

Wherein the method is for the diagnosis of prostate cell proliferative disorders, (most preferably prostate cancer, prostate carcinoma and/or neoplasms) it is also preferred that said genes and/or sequences are Gstp1 and one or more sequences selected from the group consisting of SEQ ID NO: 1017 to SEQ ID NO: 1028. Wherein the method is for the diagnosis of prostate cell proliferative disorders, (most preferably prostate cancer, prostate carcinoma and/or neoplasms) it is particularly preferred that Gstp1 and SEQ ID NO: 1023 are analysed.

Wherein the method is for the diagnosis of prostate cancer, prostate carcinoma and/or neoplasms and or differentiation thereof from benign prostate hyperplasia it is particularly preferred that SEQ ID NO: 1023 is analysed. It is also preferred that SEQ ID NO: 1023 and one or more genes and/or sequences selected from Table 26 are analysed.

It is also preferred that SEQ ID NO: 1023 and one or more genes and/or sequences selected from the group consisting GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027 are analysed.

Particularly preferred are the combinations of genes described in Tables 22 and 23, in particular the analysis of SEQ ID NO: 1023 and GSTP1.

Wherein the method is for the differentiation of one of normal prostate and/or BPH from prostate cancer it is particularly preferred that the target sequence(s) comprise, or hybridizes under stringent conditions to, one or more more sequences comprising at least 16 contiguous nucleotides of the sequences according to Table 4, said contiguous nucleotides comprising at least one CpG, TpG or CpA dinucleotide sequence.

Wherein the method is for the differentiation of one of normal prostate, normal tissue from other tissues, cancer of other tissues and/or BPH from prostate cancer it is particularly preferred that the target sequence(s) comprise, or hybridizes under stringent conditions to, one or more more sequences comprising at least 16 contiguous nucleotides of the sequences according to Table 5, said contiguous nucleotides comprising at least one CpG, TpG or CpA dinucleotide sequence.

Wherein the method is for the differentiation of prostate cancer from cancers of other tissues it is particularly preferred that the target sequence(s) comprise, or hybridizes under stringent conditions to, one or more more sequences comprising at least 16 contiguous nucleotides of the sequences according to Table 6, said contiguous nucleotides comprising at least one CpG, TpG or CpA dinucleotide sequence.

Any method known in the art for detecting proteins can be used. Such methods include, but are not limited to immunodiffusion, immunoelectrophoresis, immunochemical methods, binder-ligand assays, immunohistochemical techniques, agglutination and complement assays. (for example see Basic and Clinical Immunology, Sites and Terr, eds., Appleton & Lange, Norwalk, Conn. pp 217-262, 1991 which is incorporated by reference). Preferred are binder-ligand immunoassay methods including reacting antibodies with an epitope or epitopes and competitively displacing a labelled protein or derivative thereof.

Certain embodiments of the present invention comprise the use of antibodies specific to the polypeptide encoded by the genes or genomic sequences of the group consisting all genes and genomic sequences of genomic regions listed in Table 26.

Wherein the method is for the diagnosis of prostate cell proliferative disorders, (most preferably prostate cancer, prostate carcinoma and/or neoplasms) it is preferred that said genes and/or sequences are selected from the group consisting of SEQ ID NO: 1023, GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/OMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027

Wherein the method is for the diagnosis of prostate cell proliferative disorders, (most preferably prostate cancer, prostate carcinoma and/or neoplasms) it is also preferred that said genes and/or sequences are Gstp1 and one or more sequences selected from the group consisting of SEQ ID NO: 1017 to SEQ ID NO: 1028. Wherein the method is for the diagnosis of prostate cell proliferative disorders, (most preferably prostate cancer, prostate carcinoma and/or neoplasms) it is particularly preferred that Gstp1 and SEQ ID NO: 1023 are analysed.

Wherein the method is for the diagnosis of prostate cancer, prostate carcinoma and/or neoplasms and or differentiation thereof from benign prostate hyperplasia it is particularly preferred that SEQ ID NO: 1023 is analysed. It is also preferred that SEQ ID NO: 1023 and one or more genes and/or sequences selected from Table 26 are analysed.

It is also preferred that SEQ ID NO: 1023 and one or more genes and/or sequences selected from the group consisting GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027 are analysed.

Particularly preferred are the combinations of genes described in Tables 22 and 23, in particular the analysis of SEQ ID NO: 1023 and GSTP1.

Wherein the method is for the differentiation of one of normal prostate and/or BPH from prostate cancer it is particularly preferred that the target sequence(s) comprise, or hybridizes under stringent conditions to, one or more more sequences comprising at least 16 contiguous nucleotides of the sequences according to Table 4, said contiguous nucleotides comprising at least one CpG, TpG or CpA dinucleotide sequence.

Wherein the method is for the differentiation of one of normal prostate, normal tissue from other tissues, cancer of other tissues and/or BPH from prostate cancer it is particularly preferred that the target sequence(s) comprise, or hybridizes under stringent conditions to, one or more more sequences comprising at least 16 contiguous nucleotides of the sequences according to Table 5, said contiguous nucleotides comprising at least one CpG, TpG or CpA dinucleotide sequence.

Wherein the method is for the differentiation of prostate cancer from cancers of other tissues it is particularly preferred that the target sequence(s) comprise, or hybridizes under stringent conditions to, one or more more sequences comprising at least 16 contiguous nucleotides of the sequences according to Table 6, said contiguous nucleotides comprising at least one CpG, TpG or CpA dinucleotide sequence.

Such antibodies may be useful for detection applications, by comparing a patient's levels of prostate marker expression to expression of the same markers in healthy individuals. In certain embodiments production of monoclonal or polyclonal antibodies can be induced by the use of the coded polypeptide as antigene. Such antibodies may in turn be used to detect expressed proteins as markers for human disease states. The levels of such proteins present in the peripheral blood or tissue sample of a patient may be quantified by conventional methods. Antibody-protein binding may be detected and quantified by a variety of means known in the art, such as labelling with fluorescent or radioactive ligands. The invention further comprises kits for performing the above-mentioned procedures, wherein such kits contain antibodies specific for the investigated polypeptides.

Numerous competitive and non-competitive protein binding immunoassays are well known in the art. Antibodies employed in such assays may be unlabeled, for example as used in agglutination tests, or labelled for use a wide variety of assay methods. Labels that can be used include radionuclides, enzymes, fluorescers, chemiluminescers, enzyme substrates or co-factors, enzyme inhibitors, particles, dyes and the like for use in radioimmunoassay (RIA), enzyme immunoassays, e.g., enzyme-linked immunosorbent assay (ELISA), fluorescent immunoassays and the like. Polyclonal or monoclonal antibodies or epitopes thereof can be made for use in immunoassays by any of a number of methods known in the art. One approach for preparing antibodies to a protein is the selection and preparation of an amino acid sequence of all or part of the protein, chemically synthesising the sequence and injecting it into an appropriate animal, usually a rabbit or a mouse (Milstein and Kohler Nature 256:495-497, 1975; Gulfre and Milstein, Methods in Enzymology: Immunochemical Techniques 73:1-46, Langone and Banatis eds., Academic Press, 1981 which are incorporated by reference). Methods for preparation of the polypeptides or epitopes thereof include, but are not limited to chemical synthesis, recombinant DNA techniques or isolation from biological samples.

In a particularly preferred embodiment the expression level of the genes and/or genomic sequences according to Table 26 is determined by analysis of the level of methylation of said genes, genomic sequences and/or regulatory regions thereof.

Said analysis comprises the following steps:

i) contacting genomic DNA obtained from the subject with at least one reagent, or series of reagents that distinguishes between methylated and non-methylated CpG dinucleotides within at least one target region of the genomic DNA, wherein said contiguous nucleotides comprise at least one CpG dinucleotide sequence, ii) determining the presence or absence of a prostate cell proliferative disorders and/or a classification thereof according to the methylation status of said target regions analysed in i).

Wherein the method is for the diagnosis of prostate cell proliferative disorders, (most preferably prostate cancer, prostate carcinoma and/or neoplasms) it is preferred that said genes and/or sequences are selected from the group consisting of SEQ ID NO: 1023, GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED) MULTITRANSMEMBRANE PROTEIN, SEQ ID NO: 1019 and SEQ ID NO: 1027.

Wherein the method is for the diagnosis of prostate cell proliferative disorders, (most preferably prostate cancer, prostate carcinoma and/or neoplasms) it is also preferred that said genes and/or sequences are Gstp1 and one or more sequences selected from the group consisting of SEQ ID NO: 1017 to SEQ ID NO: 1028. Wherein the method is for the diagnosis of prostate cell proliferative disorders, (most preferably prostate cancer, prostate carcinoma and/or neoplasms) it is particularly preferred that Gstp1 and SEQ ID NO: 1023 are analysed.

Wherein the method is for the diagnosis of prostate cancer, prostate carcinoma and/or neoplasms and or differentiation thereof from benign prostate hyperplasia it is particularly preferred that SEQ ID NO: 1023 is analysed. It is also preferred that SEQ ID NO: 1023 and one or more genes and/or sequences selected from Table 26 are analysed.

It is also preferred that SEQ ID NO: 1023 and one or more genes and/or sequences selected from the group consisting GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027 are analysed.

Particularly preferred are the combinations of genes described in Tables 22 and 23, in particular the analysis of SEQ ID NO: 1023 and GSTP1.

Wherein the method is for the differentiation of one of normal prostate and/or BPH from prostate cancer it is particularly preferred that the target sequence(s) comprise, or hybridizes under stringent conditions to, one or more more sequences comprising at least 16 contiguous nucleotides of the sequences according to Table 4, said contiguous nucleotides comprising at least one CpG, TpG or CpA dinucleotide sequence.

Wherein the method is for the differentiation of one of normal prostate, normal tissue from other tissues, cancer of other tissues and/or BPH from prostate cancer it is particularly preferred that the target sequence(s) comprise, or hybridizes under stringent conditions to, one or more more sequences comprising at least 16 contiguous nucleotides of the sequences according to Table 5, said contiguous nucleotides comprising at least one CpG, TpG or CpA dinucleotide sequence.

Wherein the method is for the differentiation of prostate cancer from cancers of other tissues it is particularly preferred that the target sequence(s) comprise, or hybridizes under stringent conditions to, one or more more sequences comprising at least 16 contiguous nucleotides of the sequences according to Table 6, said contiguous nucleotides comprising at least one CpG, TpG or CpA dinucleotide sequence.

In the first step of said methylation analysis the genomic DNA to be analysed is isolated. Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants e.g. by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA.

Preferably, the source of the DNA sample is selected from the group consisting of cells or cell lines, histological slides, biopsies, paraffin-embedded tissue, bodily fluids, ejaculate, urine, blood, and combinations thereof. Preferably, the source is biopsies, bodily fluids, ejaculate, urine, or blood.

The genomic DNA sample is then treated in such a manner that cytosine bases which are unmethylated at the 5'-position are converted to uracil, thymine, or another base which is dissimilar to cytosine in terms of hybridization behavior. This will be understood as 'treatment' herein.

The above described treatment of genomic DNA is preferably carried out with bisulfite (hydrogen sulfite, disulfite) and subsequent alkaline hydrolysis which results in a conversion of non-methylated cytosine nucleobases to uracil or to another base which is dissimilar to cytosine in terms of base pairing behavior.

The treated DNA is then analysed in order to determine the methylation state of one or more target gene sequences (prior to the treatment) associated with the presence of prostate cell proliferative disorders and/or indicative of the presence of sub-types thereof. It is particularly preferred that the target region comprises, or hybridizes under stringent conditions to at least 16 contiguous nucleotides of at least one gene or genomic sequence selected from the group consisting the genes and genomic sequences as listed in Table 26. It is further preferred that the sequences of said genes in Table 26 as described in the accompanying sequence listing are analysed.

Wherein the method is for the diagnosis of prostate cell proliferative disorders, (most preferably prostate cancer, prostate carcinoma and/or neoplasms) it is preferred that the target sequence(s) comprise, or hybridizes under stringent conditions to a sequence comprising at least 16 contiguous nucleotides of the sequences selected from the group consisting of SEQ ID NO: 1023, SEQ ID NO: 57, SEQ ID NO: 20, SEQ ID NO: 36, SEQ ID NO: 1171, SEQ ID NO: 51, SEQ ID NO: 31, SEQ ID NO: 24, SEQ ID NO: 11, SEQ ID NO: 1028, SEQ ID NO: 4, SEQ ID NO: 1116, SEQ ID NO: 1025, SEQ ID NO: 1020, SEQ ID NO: 18, SEQ ID NO: 1019 and SEQ ID NO: 1027. Accordingly it is preferred that subsequent to treatment said sequences are converted to the corresponding converted or non-converted dinucleotide sequence is selected from the group consisting of SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050, and contiguous regions thereof according to Table 26.

Wherein the method is for the diagnosis of prostate cell proliferative disorders, (most preferably prostate cancer, prostate carcinoma and/or neoplasms) it is also preferred that the target sequence(s) comprise, or hybridizes under stringent conditions to a sequence comprising at least 16 contiguous nucleotides of the sequences selected from the group consisting of SEQ ID NO: 57 and one or more sequences selected from the group consisting of SEQ ID NO: 1017 to SEQ ID NO: 1028.

Wherein the method is for the diagnosis of prostate cell proliferative disorders, (most preferably prostate cancer, prostate carcinoma and/or neoplasms) it is particularly preferred that SEQ ID NO: 57 and SEQ ID NO: 1023 are analysed.

Wherein the method is for the diagnosis of prostate cancer, prostate carcinoma and/or neoplasms and/or differentiation thereof from benign prostate hyperplasia it is particularly preferred that SEQ ID NO: 1023 is analysed. It is also preferred that SEQ ID NO: 1023 and one or more genes and/or sequences selected from Table 26 are analysed.

It is also preferred that SEQ ID NO: 1023 and one or more genes and/or sequences selected from the group consisting GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027 are analysed.

Particularly preferred are the combinations of genes described in Tables 22 and 23, in particular the analysis of SEQ ID NO: 1023 and GSTP1.

Wherein the method is for the differentiation of one of normal prostate and/or BPH from prostate cancer it is particularly preferred that the target sequence(s) comprise, or hybridizes under stringent conditions to, one or more sequences comprising at least 16 contiguous nucleotides of the sequences according to Table 4, said contiguous nucleotides comprising at least one CpG, TpG or CpA dinucleotide sequence.

Wherein the method is for the differentiation of one of normal prostate, normal tissue from other tissues, cancer of other tissues and/or BPH from prostate cancer it is particularly preferred that the target sequence(s) comprise, or hybridizes under stringent conditions to, one or more more sequences comprising at least 16 contiguous nucleotides of the sequences according to Table 5, said contiguous nucleotides comprising at least one CpG, TpG or CpA dinucleotide sequence.

Wherein the method is for the differentiation of prostate cancer from cancers of other tissues it is particularly preferred that the target sequence(s) comprise, or hybridizes under stringent conditions to, one or more more sequences comprising at least 16 contiguous nucleotides of the sequences according to Table 6, said contiguous nucleotides comprising at least one CpG, TpG or CpA dinucleotide sequence.

The method of analysis may be selected from those known in the art, including those listed herein. Particularly preferred are MethyLight, MSP and the use of blocking oligonucleotides as will be described herein. It is further preferred that any oligonucleotides used in such analysis (including primers, blocking oligonucleotides and detection probes) should be reverse complementary, identical, or hybridize under stringent or highly stringent conditions to an at least 16-base-pair long segment of the base sequences of one or more of SEQ ID NOs: 60-295, 1029-1076, 1117-1120, 1172-1175 and sequences complementary thereto. It is further preferred that any oligonucleotides used in such analysis (including primers, blocking oligonucleotides and detection probes) should be reverse complementary, identical, or hybridize under stringent or highly stringent conditions to an at least 16-base-pair long segment of the base sequences of one or more of SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050 and sequences complementary thereto.

Aberrant methylation, more preferably hypermethylation of one or more genes or genomic sequences taken from those listed in Table 26 are associated with the presence of prostate cell proliferative disorders. Analysis of one or a plurality of the sequences enables the detection of and/or differentiation between prostate cell proliferative disorders.

In one embodiment the method discloses the use of one or more genes or genomic sequences selected from the group consisting the genes according to Table 26 as markers for the detection of and/or differentiation between prostate cell proliferative disorders.

Wherein the method is for the diagnosis of prostate cell proliferative disorders, (most preferably prostate cancer, prostate carcinoma and/or neoplasms) it is preferred that said genes and/or sequences are selected from the group consisting of SEQ ID NO: 1023, GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAT NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027

Wherein the method is for the diagnosis of prostate cell proliferative disorders, (most preferably prostate cancer, prostate carcinoma and/or neoplasms) it is also preferred that said genes and/or sequences are Gstp1 and one or more sequences selected from the group consisting of SEQ ID NO: 1017 to SEQ ID NO: 1028. Wherein the method is for the diagnosis of prostate cell proliferative disorders, (most preferably prostate cancer, prostate carcinoma and/or neoplasms) it is particularly preferred that Gstp1 and SEQ ID NO: 1023 are analysed.

Wherein the method is for the diagnosis of prostate cancer, prostate carcinoma and/or neoplasms and or differentiation thereof from benign prostate hyperplasia it is particularly preferred that SEQ ID NO: 1023 is analysed. It is also preferred that SEQ ID NO: 1023 and one or more genes and/or sequences selected from Table 26 are analysed.

It is also preferred that SEQ ID NO: 1023 and one or more genes and/or sequences selected from the group consisting GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027 are analysed.

Particularly preferred are the combinations of genes described in Tables 22 and 23, in particular the analysis of SEQ ID NO: 1023 and GSTP1.

Wherein the method is for the differentiation of one of normal prostate and/or BPH from prostate cancer it is particularly preferred that the target sequence(s) comprise, or hybridizes under stringent conditions to, one or more more sequences comprising at least 16 contiguous nucleotides of the sequences according to Table 4, said contiguous nucleotides comprising at least one CpG, TpG or CpA dinucleotide sequence.

Wherein the method is for the differentiation of one of normal prostate, normal tissue from other tissues, cancer of other tissues and/or BPH from prostate cancer it is particularly preferred that the target sequence(s) comprise, or hybridizes under stringent conditions to, one or more more sequences comprising at least 16 contiguous nucleotides of the sequences according to Table 5, said contiguous nucleotides comprising at least one CpG, TpG or CpA dinucleotide sequence.

Wherein the method is for the differentiation of prostate cancer from cancers of other tissues it is particularly preferred that the target sequence(s) comprise, or hybridizes under stringent conditions to, one or more more sequences comprising at least 16 contiguous nucleotides of the sequences according to Table 6, said contiguous nucleotides comprising at least one CpG, TpG or CpA dinucleotide sequence.

The present invention may also be described in certain embodiments as a kit for use in the detection of and/or differentiation between a prostate cell proliferative disorder state through testing of a biological sample. A representative kit may comprise one or more nucleic acid segments that selectively hybridise to the mRNA and a container for each of the one or more nucleic acid segments. In certain embodiments the nucleic acid segments may be combined in a single tube. In further embodiments, the nucleic acid segments may also include a pair of primers for amplifying the target mRNA. Such kits may also include any buffers, solutions, solvents, enzymes, nucleotides, or other components for hybridisation, amplification or detection reactions. Preferred kit components include reagents for reverse transcription-PCR, in situ hybridisation, Northern analysis and/or RPA Particular embodiments of the present invention provide a novel application of the analysis of methylation levels and/or patterns within said sequences that enables the early detection and thereby improved treatment of prostate cell proliferative disorders, furthermore said method enables the differentiation of benign conditions from conditions such as prostate carcinoma and neoplasms which may be potentially malignant and have much more serious health consequences for the patient. Treatment of prostate cell proliferative disorders is improved by early detection, and the disclosed method thereby enables the physician and patient to make better and more informed treatment decisions.

Further Improvements

The present invention provides novel uses for genomic sequences selected from the group consisting of SEQ ID NO: 1 TO SEQ ID NO: 59, SEQ ID NO: 1017 TO SEQ ID NO: 1028, SEQ ID NO: 1116 AND SEQ ID NO: 1171. Additional embodiments provide modified variants of SEQ ID NO: 1 TO SEQ ID NO: 59, SEQ ID NO: 1017 TO SEQ ID NO: 1028, SEQ ID NO: 1116 AND SEQ ID NO: 1171, as well as oligonucleotides and/or PNA-oligomers for analysis of cytosine methylation patterns within the group consisting SEQ ID NO: 1 TO SEQ ID NO: 59, SEQ ID NO: 1017 TO SEQ ID NO: 1028, SEQ ID NO: 1116 AND SEQ ID NO: 1171.

An objective of the invention comprises analysis of the methylation state of one or more CpG dinucleotides within at least one of the genomic sequences selected from the group consisting of SEQ ID NO: 1 TO SEQ ID NO: 59, SEQ ID NO: 1017 TO SEQ ID NO: 1028, SEQ ID NO: 1116 AND SEQ ID NO:1171 and sequences complementary thereto.

The disclosed invention provides treated nucleic acids, derived from genomic SEQ ID NO: 1 to SEQ ID NO: 59, SEQ ID NO: 1017 to SEQ ID NO: 1028, SEQ ID NO: 1116 and SEQ ID NO:1171, wherein the treatment is suitable to convert at least one unmethylated cytosine base of the genomic DNA sequence to uracil or another base that is detectably dissimilar to cytosine in terms of hybridization. The genomic sequences in question may comprise one, or more, consecutive or random methylated CpG positions. Said treatment preferably comprises use of a reagent selected from the group consisting of bisulfite, hydrogen sulfite, disulfite, and combinations thereof. In a preferred embodiment of the invention, the objective comprises analysis of a non-naturally occurring modified nucleic acid comprising a sequence of at least 16 contiguous nucleotide bases in length of a sequence selected from the group consisting of SEQ ID NOS: 60-295, 1029-1076, 1117-1120, 1172-1175, wherein said sequence comprises at least one CpG, TpA or CpA dinucleotide and sequences complementary thereto. In a further preferred embodiment of the invention, the objective comprises analysis of a non-naturally occurring modified nucleic acid comprising a sequence of at least 16 contiguous nucleotide bases in length of a sequence selected from the group consisting of SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050 wherein said sequence comprises at least one CpG, TpA or CpA dinucleotide and sequences complementary thereto. The sequences of SEQ ID NO: 60-295, 1029-1076, 1117-1120, 1171-1175 provide non-naturally occurring modified versions of the nucleic acid according to SEQ ID NO: 1 TO SEQ ID NO: 59, SEQ ID NO: 1017 TO SEQ ID NO: 1028, SEQ ID NO: 1116 AND SEQ ID NO:1171, wherein the modification of each genomic sequence results in the synthesis of a nucleic acid having a sequence that is unique and distinct from said genomic sequence as follows. For each sense strand genomic DNA, e.g., SEQ ID NO: 1, four converted versions are disclosed. A first version wherein "C" is converted to "T," but "CpG" remains "CpG" (i.e., corresponds to case where, for the genomic sequence, all "C" residues of CpG dinucleotide sequences are methylated and are thus not-converted); a second version discloses the complement of the disclosed genomic DNA sequence (i.e. antisense strand), wherein "C" is converted to "T," but "CpG" remains "CpG" (i.e. corresponds to case where, for all "C" residues of CpG dinucleotide sequences are methylated and are thus not converted).

In an alternative preferred embodiment, such analysis comprises the use of an oligonucleotide or oligomer for detecting the cytosine methylation state within genomic or treated (non-naturally occurring modified) DNA, according to SEQ ID NO: 1 to SEQ ID NO: 59, SEQ ID NO: 1017 to SEQ ID NO: 1028, SEQ ID NO: 1116, SEQ ID NO:1171, SEQ ID NO: 60-295, 1029-1076, 1117-1120, 1171-1175. In a preferred embodiment, such analysis comprises the use of an oligonucleotide or oligomer for detecting the cytosine methylation state within genomic or treated (chemically modified) DNA, according to SEQ ID NOS: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050.

Said oligonucleotide or oligomer each comprising a nucleic acid sequence having a length of at least nine (9) nucleotides which hybridizes, under moderately stringent or stringent conditions (as defined herein above), to a treated nucleic acid sequence according to SEQ ID NO: 60-295, 1029-1076, 1117-1120, 1171-1175 and/or sequences complementary thereto, or to a genomic sequence according to SEQ ID NO: 1 to SEQ ID NO: 59, SEQ ID NO: 1017 to SEQ ID NO: 1028, SEQ ID NO: 1116 and SEQ ID NO:1171 and/or sequences complementary thereto.

Particularly preferred is an oligonucleotide or oligomer comprising a nucleic acid sequence having a length of at least nine (9) nucleotides which hybridizes, under moderately stringent or stringent conditions (as defined herein above), to a treated nucleic acid sequence according to SEQ ID NOS: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050 and/or sequences complementary thereto.

Thus, the present invention includes nucleic acid molecules (e.g., oligonucleotides and peptide nucleic acid (PNA) molecules (PNA-oligomers)) that hybridize under moderately stringent and/or stringent hybridization conditions to all or a portion of the sequences SEQ ID NO: 1 to SEQ ID NO: 59, SEQ ID NO: 1017 to SEQ ID NO: 1028, SEQ ID NO: 1116, SEQ ID NO:1171, SEQ ID NOs: 60-295, 1029-1076, 1117-1120, 1172-1175, or to the complements thereof. The hybridizing portion of the hybridizing nucleic acids is typically at least 9, 15, 20, 25, 30 or 35 nucleotides in length. However, longer molecules have inventive utility, and are thus within the scope of the present invention.

Preferably, the hybridizing portion of the inventive hybridizing nucleic acids is at least 95%, or at least 98%, or 100% identical to the sequence, or to a portion thereof of SEQ ID NOs: 60-295, 1029-1076, 1117-1120, 1172-1175 or to the complements thereof.

Hybridizing nucleic acids of the type described herein can be used, for example, as a primer (e.g., a PCR primer), or a diagnostic and/or classification probe or primer. Preferably, hybridization of the oligonucleotide probe to a nucleic acid sample is performed under stringent conditions and the probe is 100% identical to the target sequence. Nucleic acid duplex or hybrid stability is expressed as the melting temperature or Tm, which is the temperature at which a probe dissociates from a target DNA. This melting temperature is used to define the required stringency conditions.

For target sequences that are related and substantially identical to the corresponding sequence of SEQ ID NO: 1 to SEQ ID NO: 59, SEQ ID NO: 1017 to SEQ ID NO: 1028, SEQ ID NO: 1116 and SEQ ID NO: 1171 (such as allelic variants and SNPs), rather than identical, it is useful to first establish the lowest temperature at which only homologous hybridization occurs with a particular concentration of salt (e.g., SSC or SSPE). Then, assuming that 1% mismatching results in a 1° C. decrease in the Tm, the temperature of the final wash in the hybridization reaction is reduced accordingly (for example, if sequences having >95% identity with the probe are sought, the final wash temperature is decreased by 5° C.). In practice, the change in Tm can be between 0.5° C. and 1.5° C. per 1% mismatch.

Examples of inventive oligonucleotides of length X (in nucleotides), as indicated by polynucleotide positions with reference to, e.g., SEQ ID NO:1, include those corresponding to sets (sense and antisense sets) of consecutively overlapping oligonucleotides of length X, where the oligonucleotides within each consecutively overlapping set (corresponding to a given X value) are defined as the finite set of Z oligonucleotides from nucleotide positions: n to (n+(X−1));

where n=1, 2, 3, . . . (Y−(X−1));

where Y equals the length (nucleotides or base pairs) of SEQ ID NO: 1 (2299);

where X equals the common length (in nucleotides) of each oligonucleotide in the set (e.g., X=20 for a set of consecutively overlapping 20-mers); and where the number (Z) of consecutively overlapping oligomers of length X for a given SEQ ID NO of length Y is equal to Y−(X−1). For example Z=2299−19=2280 for either sense or antisense sets of SEQ ID NO:1, where X=20.

Preferably, the set is limited to those oligomers that comprise at least one CpG, TpG or CpA dinucleotide.

Examples of inventive 20-mer oligonucleotides include the following set of 2280 oligomers (and the antisense set complementary thereto), indicated by polynucleotide positions with reference to SEQ ID NO:1:

1-20, 2-21, 3-22, 4-23, 5-24 . . . 2280-2299.

Preferably, the set is limited to those oligomers that comprise at least one CpG, TpG or CpA dinucleotide.

Likewise, examples of inventive 25-mer oligonucleotides include the following set of 2,256 oligomers (and the antisense set complementary thereto), indicated by polynucleotide positions with reference to SEQ ID NO:1:

1-25, 2-26, 3-27, 4-28, 5-29 . . . 2280-2299.

Preferably, the set is limited to those oligomers that comprise at least one CpG, TpG or CpA dinucleotide.

The present invention encompasses, for each of SEQ ID NO: 1 to SEQ ID NO: 59, SEQ ID NO: 1017 to SEQ ID NO: 1028, SEQ ID NO: 1116, SEQ ID NO:1171, SEQ ID NOs: 60-295, 1029-1076, 1117-1120, 1172-1175 (sense and antisense), multiple consecutively overlapping sets of oligonucleotides or modified oligonucleotides of length X, where, e.g., X=9, 10, 17, 20, 22, 23, 25, 27, 30 or 35 nucleotides.

The oligonucleotides or oligomers according to the present invention constitute effective tools useful to ascertain genetic and epigenetic parameters of the genomic sequence corresponding to SEQ ID NO: 1 to SEQ ID NO: 59, SEQ ID NO: 1017 to SEQ ID NO: 1028, SEQ ID NO: 1116 and SEQ ID NO:1171. Preferably, said oligomers comprise at least one CpG, TpG or CpA dinucleotide.

Particularly preferred oligonucleotides or oligomers according to the present invention are those in which the cytosine of the CpG dinucleotide (or of the corresponding converted TpG or CpA dinucleotide) sequences is within the middle third of the oligonucleotide; that is, where the oligonucleotide is, for example, 13 bases in length, the CpG, TpG or CpA dinucleotide is positioned within the fifth to ninth nucleotide from the 5'-end.

The oligonucleotides of the invention can also be modified by chemically linking the oligonucleotide to one or more moieties or conjugates to enhance the activity, stability or detection of the oligonucleotide. Such moieties or conjugates include chromophores, fluorophors, lipids such as cholesterol, cholic acid, thioether, aliphatic chains, phospholipids, polyamines, polyethylene glycol (PEG), palmityl moieties, and others as disclosed in, for example, U.S. Pat. Nos. 5,514,758, 5,565,552, 5,567,810, 5,574,142, 5,585,481, 5,587,371, 5,597,696 and 5,958,773. The probes may also exist in the form of a PNA (peptide nucleic acid) which has particularly preferred pairing properties. Thus, the oligonucleotide may include other appended groups such as peptides, and may include hybridization-triggered cleavage agents (Krol et al., *BioTechniques* 6:958-976, 1988) or intercalating agents (Zon, *Pharm. Res.* 5:539-549, 1988). To this end, the oligonucleotide may be conjugated to another molecule, e.g., a chromophore, fluorophor, peptide, hybridization-triggered cross-linking agent, transport agent, hybridization-triggered cleavage agent, etc.

The oligonucleotide may also comprise at least one art-recognized modified sugar and/or base moiety, or may comprise a modified backbone or non-natural internucleoside linkage.

The oligonucleotides or oligomers according to particular embodiments of the present invention are typically used in 'sets,' which contain at least one oligomer for analysis of each of the CpG dinucleotides of genomic sequences SEQ ID NO: 1 to SEQ ID NO: 59, SEQ ID NO: 1017 to SEQ ID NO: 1028, SEQ ID NO: 1116 and SEQ ID NO:1171 and sequences complementary thereto, or to the corresponding CpG, TpG or CpA dinucleotide within a sequence of the treated nucleic acids according to SEQ ID NO: 60-295, 1029-1076, 1117-1120, 1171-1175 1017 to SEQ ID NO: 1028 and sequences complementary thereto. However, it is anticipated that for economic or other factors it may be preferable to analyze a limited selection of the CpG dinucleotides within said sequences, and the content of the set of oligonucleotides is altered accordingly.

Therefore, in particular embodiments, the present invention provides a set of at least two (2) (oligonucleotides and/or PNA-oligomers) useful for detecting the cytosine methylation state in treated genomic DNA (SEQ ID NOs: 60-295, 1029-1076, 1117-1120, 1172-1175), or in genomic DNA (SEQ ID NO: 1 to SEQ ID NO: 59, SEQ ID NO: 1017 to SEQ ID NO: 1028, SEQ ID NO: 1116 and SEQ ID NO:1171 and sequences complementary thereto). These probes enable diagnosis and/or classification of genetic and epigenetic parameters of prostate cell proliferative disorders. The set of oligomers may also be used for detecting single nucleotide polymorphisms (SNPs) in treated genomic DNA (SEQ ID NOs: 60-295, 1029-1076, 1117-1120, 1172-1175), or in genomic DNA (SEQ ID NO: 1 to SEQ ID NO: 59, SEQ ID NO: 1017 to SEQ ID NO: 1028, SEQ ID NO: 1116 and SEQ ID NO:1171 and sequences complementary thereto).

Particularly preferred is a set of at least two (2) (oligonucleotides and/or PNA-oligomers) useful for detecting the cytosine methylation state in treated genomic DNA according to SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050.

In preferred embodiments, at least one, and more preferably all members of a set of oligonucleotides is bound to a solid phase.

In further embodiments, the present invention provides a set of at least two (2) oligonucleotides that are used as 'primer' oligonucleotides for amplifying DNA sequences of one of SEQ ID NO: 1 to SEQ ID NO: 59, SEQ ID NO: 1017 to SEQ ID NO: 1028, SEQ ID NO: 1116, SEQ ID NO:1171, SEQ ID NOs: 60-295, 1029-1076, 1117-1120, 1172-1175 and sequences complementary thereto, or segments thereof.

Particularly preferred is a a set of at least two (2) oligonucleotides that are used as 'primer' oligonucleotides for amplifying DNA sequences of one of SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050.

It is anticipated that the oligonucleotides may constitute all or part of an "array" or "DNA chip" (i.e., an arrangement of different oligonucleotides and/or PNA-oligomers bound to a solid phase). Such an array of different oligonucleotide- and/or PNA-oligomer sequences can be characterized, for example, in that it is arranged on the solid phase in the form of a rectangular or hexagonal lattice. The solid-phase surface may be composed of silicon, glass, polystyrene, aluminum, steel, iron, copper, nickel, silver, or gold. Nitrocellulose as well as plastics such as nylon, which can exist in the form of pellets or also as resin matrices, may also be used. An overview of the Prior Art in oligomer array manufacturing can be gathered from a special edition of Nature Genetics (Nature Genetics Supplement, Volume 21, January 1999, and from the literature cited therein). Fluorescently labeled probes are often used for the scanning of immobilized DNA arrays. The simple attachment of Cy3 and Cy5 dyes to the 5'-OH of the specific probe are particularly suitable for fluorescence labels. The detection of the fluorescence of the hybridized probes may be carried out, for example, via a confocal microscope. Cy3 and Cy5 dyes, besides many others, are commercially available.

It is also anticipated that the oligonucleotides, or particular sequences thereof, may constitute all or part of an "virtual array" wherein the oligonucleotides, or particular sequences thereof, are used, for example, as 'specifiers' as part of, or in combination with a diverse population of unique labeled probes to analyze a complex mixture of analytes. Such a method, for example is described in US 2003/0013091 (U.S. Ser. No. 09/898,743, published 16 Jan. 2003). In such methods, enough labels are generated so that each nucleic acid in the complex mixture (i.e., each analyte) can be uniquely bound by a unique label and thus detected (each label is directly counted, resulting in a digital read-out of each molecular species in the mixture).

It is particularly preferred that the oligomers according to the invention are utilised for at least one of: detection of; screening of populations for; differentiation between; monitoring of; and detection and monitoring of prostate cell proliferative disorders. This is enabled by use of said sets for the detection of and/or differentiation between prostate cell proliferative disorders in a biological sample isolated from a patient. Particularly preferred are those sets of oligomer that comprise at least two oligonucleotides selected from one of the following sets of oligonucleotides.

In one embodiment of the method, this is achieved by analysis of the methylation status of at least one target sequence comprising, or hybridizing under stringent conditions to at least 16 contiguous nucleotides of a gene or sequence selected from the group consisting the genes and sequences according to Table 26 and complements thereof.

Wherein the method is for the diagnosis of prostate cell proliferative disorders, (most preferably prostate cancer, prostate carcinoma and/or neoplasms) it is preferred that said genes and/or sequences are selected from the group consisting of SEQ ID NO: 1023, GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANS-MEMBRANE PROTEIN, SEQ ID NO: 1019 and SEQ ID NO: 1027.

Wherein the method is for the diagnosis of prostate cell proliferative disorders, (most preferably prostate cancer, prostate carcinoma and/or neoplasms) it is also preferred that said genes and/or sequences are Gstp1 and one or more sequences selected from the group consisting of SEQ ID NO: 1017 to SEQ ID NO: 1028. Wherein the method is for the diagnosis of prostate cell proliferative disorders, (most preferably prostate cancer, prostate carcinoma and/or neoplasms) it is particularly preferred that Gstp1 and SEQ ID NO: 1023 are analysed.

Wherein the method is for the diagnosis of prostate cancer, prostate carcinoma and/or neoplasms and or differentiation thereof from benign prostate hyperplasia it is particularly preferred that SEQ ID NO: 1023 is analysed. It is also preferred that SEQ ID NO: 1023 and one or more genes and/or sequences selected from Table 26 are analysed. It is also preferred that SEQ ID NO: 1023 and one or more genes and/or sequences selected from the group consisting GSTP1, PROSTAGLANDIN E2 RECEPTOR, HISTONE H4, RASSF1A, PR-DOMAIN ZINC FINGER PROTEIN 16, LIM DOMAIN KINASE 1, ORPHAN NUCLEAR RECEPTOR NR5A2, SEQ ID NO: 11, SEQ ID NO: 1028, LIM/HOMEOBOX PROTEIN LHX9, SEQ ID NO: 1116, SEQ ID NO: 1025, SEQ ID NO: 1020, LYSOSOMAL-ASSOCIATED MULTITRANSMEMBRANE PROTEIN, SEQ ID NO: 1019 and SEQ ID NO: 1027 are analysed.

Particularly preferred are the combinations of genes described in Tables 22 and 23, in particular the analysis of SEQ ID NO: 1023 and GSTP1.

Wherein the method is for the differentiation of one of normal prostate and/or BPH from prostate cancer it is particularly preferred that the target sequence(s) comprise, or hybridizes under stringent conditions to, one or more more sequences comprising at least 16 contiguous nucleotides of the sequences according to Table 4, said contiguous nucleotides comprising at least one CpG, TpG or CpA dinucleotide sequence.

Wherein the method is for the differentiation of one of normal prostate, normal tissue from other tissues, cancer of other tissues and/or BPH from prostate cancer it is particularly preferred that the target sequence(s) comprise, or hybridizes under stringent conditions to, one or more more sequences comprising at least 16 contiguous nucleotides of the sequences according to Table 5, said contiguous nucleotides comprising at least one CpG, TpG or CpA dinucleotide sequence.

Wherein the method is for the differentiation of prostate cancer from cancers of other tissues it is particularly preferred that the target sequence(s) comprise, or hybridizes under stringent conditions to, one or more more sequences comprising at least 16 contiguous nucleotides of the sequences according to Table 6, said contiguous nucleotides comprising at least one CpG, TpG or CpA dinucleotide sequence.

The present invention further provides a method for ascertaining genetic and/or epigenetic parameters of the genomic sequences according to SEQ ID NO: 1 to SEQ ID NO: 59, SEQ ID NO: 1017 to SEQ ID NO: 1028, SEQ ID NO: 1116 and SEQ ID NO:1171 within a subject by analyzing cytosine methylation and single nucleotide polymorphisms. Said method comprising contacting a nucleic acid comprising one or more of SEQ ID NO: 1 to SEQ ID NO: 59, SEQ ID NO: 1017 to SEQ ID NO: 1028, SEQ ID NO: 1116 and SEQ ID NO:1171 in a biological sample obtained from said subject with at least one reagent or a series of reagents, wherein said reagent or series of reagents, distinguishes between methylated and non-methylated CpG dinucleotides within the target nucleic acid.

Preferably, said method comprises the following steps: In the first step, a sample of the tissue to be analysed is obtained. Preferably, the source of the DNA sample is selected from the group consisting of cells or cell lines, histological slides, biopsies, paraffin-embedded tissue, bodily fluids, ejaculate, urine, blood, and combinations thereof. Preferably, the source is biopsies, bodily fluids, ejaculate, urine, or blood.

The genomic DNA is then isolated from the sample. Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants e.g. by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA.

Once the nucleic acids have been extracted, the genomic double stranded DNA is used ill the analysis.

In the second step of the method, the genomic DNA sample is treated in such a manner that cytosine bases which are unmethylated at the 5'-position are converted to uracil, thymine, or another base which is dissimilar to cytosine in terms of hybridization behavior. This will be understood as 'pretreatment' or 'treatment' herein.

The above-described treatment of genomic DNA is preferably carried out with bisulfite (hydrogen sulfite, disulfite) and subsequent alkaline hydrolysis which results in a conversion of non-methylated cytosine nucleobases to uracil or to another base which is dissimilar to cytosine in terms of base pairing behavior.

In the third step of the method, fragments of the treated DNA are amplified, using sets of primer oligonucleotides according to the present invention, and an amplification enzyme. The amplification of several DNA segments can be carried out simultaneously in one and the same reaction vessel. Typically, the amplification is carried out using a polymerase chain reaction (PCR). The set of primer oligonucleotides includes at least two oligonucleotides whose sequences are each reverse complementary, identical, or hybridize under stringent or highly stringent conditions to an at least 16-base-pair long segment of the base sequences of one of SEQ ID NOs: 60-295, 1029-1076, 1117-1120, 1172-1175 and sequences complementary thereto.

Particularly preferred is a set of primer oligonucleotides includes at least two oligonucleotides whose sequences are each reverse complementary, identical, or hybridize under stringent or highly stringent conditions to an at least 16-base-pair long segment of the base sequences of one of SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050 and sequences complementary thereto.

In an alternate embodiment of the method, the methylation status of preselected CpG positions within the nucleic acid sequences comprising one or more of SEQ ID NO: 1 to SEQ ID NO: 59, SEQ ID NO: 1017 to SEQ ID NO: 1028, SEQ ID NO: 1116 and SEQ ID NO:1171 may be detected by use of methylation-specific primer oligonucleotides. This technique (MSP) has been described in U.S. Pat. No. 6,265,171 to Herman. The use of methylation status specific primers for the amplification of bisulfite treated DNA allows the differentiation between methylated and unmethylated nucleic acids. MSP primers pairs contain at least one primer which hybridizes to a bisulfite treated CpG dinucleotide. Therefore, the sequence of said primers comprises at least one CpG dinucleotide. MSP primers specific for non-methylated DNA contain a "T" at the position of the C position in the CpG. Preferably, therefore, the base sequence of said primers is required to comprise a sequence having a length of at least 9 nucleotides which hybridizes to a treated nucleic acid sequence according to one of SEQ ID NOs: 60-295, 1029-1076, 1117-1120, 1172-1175 and sequences complementary thereto, wherein the base sequence of said oligomers comprises at least one CpG dinucleotide.

Preferably, the base sequence of said primers is required to comprise a sequence having a length of at least 9 nucleotides which hybridizes to a treated nucleic acid; sequence according to one of SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050 and sequences complementary thereto, wherein the base sequence of said oligomers comprises at least one CpG dinucleotide.

A further preferred embodiment of the method comprises the use of blocker oligonucleotides. The use of such blocker oligonucleotides has been described by Yu et al., *BioTechniques* 23:714-720, 1997. Blocking probe oligonucleotides are hybridized to the bisulfite treated nucleic acid concurrently with the PCR primers. PCR amplification of the nucleic acid is terminated at the 5' position of the blocking probe, such that amplification of a nucleic acid is suppressed where the complementary sequence to the blocking probe is present. The probes may be designed to hybridize to the bisulfite treated nucleic acid in a methylation status specific manner. For example, for detection of methylated nucleic acids within a population of unmethylated nucleic acids, suppression of the amplification of nucleic acids which are unmethylated at the position in question would be carried out by the use of blocking probes comprising a 'CpA' or 'TpA' at the position in question, as opposed to a 'CpG' if the suppression of amplification of methylated nucleic acids is desired.

For PCR methods using blocker oligonucleotides, efficient disruption of polymerase-mediated amplification requires that blocker oligonucleotides not be elongated by the polymerase. Preferably, this is achieved through the use of blockers that are 3'-deoxyoligonucleotides, or oligonucleotides derivitized at the 3' position with other than a "free" hydroxyl group. For example, 3'-O-acetyl oligonucleotides are representative of a preferred class of blocker molecule.

Additionally, polymerase-mediated decomposition of the blocker oligonucleotides should be precluded. Preferably, such preclusion comprises either use of a polymerase lacking 5'-3' exonuclease activity, or use of modified blocker oligonucleotides having, for example, thioate bridges at the 5'-terminii thereof that render the blocker molecule nuclease-resistant. Particular applications may not require such 5' modifications of the blocker. For example, if the blocker- and primer-binding sites overlap, thereby precluding binding of the primer (e.g., with excess blocker), degradation of the blocker oligonucleotide will be substantially precluded. This is because the polymerase will not extend the primer toward, and through (in the 5'-3' direction) the blocker—a process that normally results in degradation of the hybridized blocker oligonucleotide.

A particularly preferred blocker/PCR embodiment, for purposes of the present invention and as implemented herein, comprises the use of peptide nucleic acid (PNA) oligomers as blocking oligonucleotides. Such PNA blocker oligomers are ideally suited, because they are neither decomposed nor extended by the polymerase.

Preferably, therefore, the base sequence of said blocking oligonucleotides is required to comprise a sequence having a length of at least 9 nucleotides which hybridizes to a treated nucleic acid sequence according to one of SEQ ID NOs: 60-295, 1029-1076, 1117-1120, 1172-1175 and sequences complementary thereto, wherein the base sequence of said oligonucleotides comprises at least one CpG, TpG or CpA dinucleotide.

It is further preferred that the base sequence of said blocking oligonucleotides is required to comprise a sequence having a length of at least 9 nucleotides which hybridizes to a treated nucleic acid sequence according to one of SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050 and sequences complementary thereto, wherein the base sequence of said oligonucleotides comprises at least one CpG, TpG or CpA dinucleotide.

The fragments obtained by means of the amplification can carry a directly or indirectly detectable label. Preferred are labels in the form of fluorescence labels, radionuclides, or detachable molecule fragments having a typical mass which can be detected in a mass spectrometer. Where said labels are mass labels, it is preferred that the labeled amplificates have a single positive or negative net charge, allowing for better detectability in the mass spectrometer. The detection may be carried out and visualized by means of, e.g. matrix assisted laser desorption/ionization mass spectrometry (MALDI) or using electron spray mass spectrometry (ESI).

Matrix Assisted Laser Desorption/Ionization Mass Spectrometry (MALDI-TOF) is a very efficient development for the analysis of biomolecules (Karas & Hillenkamp, *Anal Chem.*, 60:2299-301, 1988). An analyte is embedded in a light-absorbing matrix. The matrix is evaporated by a short laser pulse thus transporting the analyte molecule into the vapour phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones. MALDI-TOF spectrometry is well suited to the analysis of peptides and proteins. The analysis of nucleic acids is somewhat more difficult (Gut & Beck, *Current Innovations and Future Trends*, 1:147-57, 1995). The sensitivity with respect to nucleic acid analysis is approximately 100-times less than for peptides, and decreases disproportionally with increasing fragment size. Moreover, for nucleic acids having a multiply negatively charged backbone, the ionization process via the matrix is considerably less efficient. In MALDI-TOF spectrometry, the selection of the matrix plays an eminently important role. For desorption of peptides, several very efficient matrixes have been found which produce a very fine crystallisation. There are now several responsive matrixes for DNA, however, the difference in sensitivity between peptides and nucleic acids has not been reduced. This difference in sensitivity can be reduced, however, by chemically modifying the DNA in such a manner that it becomes more similar to a peptide. For example, phosphorothioate nucleic acids, in which the usual phosphates of the backbone are substituted with thiophosphates, can be converted into a charge-neutral DNA using simple alkylation chemistry (Gut & Beck, *Nucleic Acids Res.* 23: 1367-73, 1995). The coupling of a charge tag to this modified DNA results in an increase in MALDI-TOF sensitivity to the same level as that found for peptides. A further advantage of charge tagging is the increased stability of the analysis against impurities, which makes the detection of unmodified substrates considerably more difficult.

In the fourth step of the method, the amplificates obtained during the third step of the method are analysed in order to ascertain the methylation status of the CpG dinucleotides prior to the treatment.

In embodiments where the amplificates were obtained by means of MSP amplification, the presence or absence of an amplificate is in itself indicative of the methylation state of the CpG positions covered by the primer, according to the base sequences of said primer. Amplificates obtained by means of both standard and methylation specific PCR may be further analyzed by means of hybridization-based methods such as, but not limited to, array technology and probe based technologies as well as by means of techniques such as sequencing and template directed extension.

In one embodiment of the method, the amplificates synthesised in step three are subsequently hybridized to an array or a set of oligonucleotides and/or PNA probes. In this context, the hybridization takes place in the following manner: the set of probes used during the hybridization is preferably composed of at least 2 oligonucleotides or PNA-oligomers; in the process, the amplificates serve as probes which hybridize to oligonucleotides previously bonded to a solid phase; the non-hybridized fragments are subsequently removed; said oligonucleotides contain at least one base sequence having a length of at least 9 nucleotides which is reverse complementary or identical to a segment of the base sequences specified in the present Sequence Listing; and the segment comprises at least one CpG, TpG or CpA dinucleotide.

In a preferred embodiment, said dinucleotide is present in the central third of the oligomer. For example, wherein the oligomer comprises one CpG dinucleotide, said dinucleotide is preferably the fifth to ninth nucleotide from the 5'-end of a 13-mer. One oligonucleotide exists for the analysis of each CpG dinucleotide within the sequence according to SEQ ID NO: 1 to SEQ ID NO: 59, SEQ ID NO: 1017 to SEQ ID NO: 1028, SEQ ID NO: 1116 and SEQ ID NO:1171, and the equivalent positions within SEQ ID NOs: 60-295, 1029-1076, 1117-1120, 1172-1175.

Said oligonucleotides may also be present in the form of peptide nucleic acids. The non-hybridized amplificates are then removed. The hybridized amplificates are then detected. In this context, it is preferred that labels attached to the amplificates are identifiable at each position of the solid phase at which an oligonucleotide sequence is located.

In yet a further embodiment of the method, the genomic methylation status of the CpG positions may be ascertained by means of oligonucleotide probes that are hybridised to the bisulfite treated DNA concurrently with the PCR amplification primers (wherein said primers may either be methylation specific or standard).

A particularly preferred embodiment of this method is the use of fluorescence-based Real Time Quantitative PCR (Heid et al., *Genome Res.* 6:986-994, 1996; also see U.S. Pat. No. 6,331,393) employing a dual-labeled fluorescent oligonucleotide probe (TaqMan™ PCR, using an ABI Prism 7700 Sequence Detection System, Perkin Elmer Applied Biosystems, Foster City, Calif.). The TaqMan™ PCR reaction employs the use of a nonextendible interrogating oligonucleotide, called a TaqMan™ probe, which, in preferred embodiments, is designed to hybridize to a GpC-rich sequence located between the forward and reverse amplification primers. The TaqMan™ probe-further comprises a fluorescent "reporter moiety" and a "quencher moiety" covalently bound to linker moieties (e.g., phosphoramidites) attached to the nucleotides of the TaqMan™ oligonucleotide. For analysis of methylation within nucleic acids subsequent to bisulfite treatment, it is required that the probe be methylation specific, as described in U.S. Pat. No. 6,331,393, (hereby incorporated by reference in its entirety) also known as the MethylLight™ assay. Variations on the TaqMan™ detection methodology that are also suitable for use with the described invention include the use of dual-probe technology (Lightcycler™) or fluorescent amplification primers (Sunrise™ technology). Both these techniques may be adapted in a manner suitable for use with bisulfite treated DNA, and moreover for methylation analysis within CpG dinucleotides.

A further suitable method for the use of probe oligonucleotides for the assessment of methylation by analysis of bisulfite treated nucleic acids In a further preferred embodiment of the method, the fourth step of the method comprises the use of template-directed oligonucleotide extension, such as MS-SNuPE as described by Gonzalgo & Jones, *Nucleic Acids Res.* 25:2529-2531, 1997.

In yet a further embodiment of the method, the fourth step of the method comprises sequencing and subsequent sequence analysis of the amplificate generated in the third step of the method (Sanger F., et al., *Proc Natl Acad Sci USA* 74:5463-5467, 1977).

Best Mode

In the most preferred embodiment of the method the genomic nucleic acids are isolated and treated according to the first three steps of the method outlined above, namely:
a) obtaining, from a subject, a biological sample having subject genomic DNA;
b) extracting or otherwise isolating the genomic DNA;
c) treating the genomic DNA of b), or a fragment thereof, with one or more reagents to convert cytosine bases that are unmethylated in the 5-position thereof to uracil or to another base that is detectably dissimilar to cytosine in terms of hybridization properties; and wherein
d) amplifying subsequent to treatment in c) is carried out in a methylation specific manner, namely by use of methylation specific primers or blocking oligonucleotides, and further wherein
e) detecting of the amplificates is carried out by means of a real-time detection probe, as described above.

Preferably, where the subsequent amplification of d) is carried out by means of methylation specific primers, as described above, said methylation specific primers comprise a sequence having a length of at least 9 nucleotides which hybridizes to a treated nucleic acid sequence according to one of SEQ ID NOs: 60-295, 1029-1076, 1117-1120, 1172-1175 and sequences complementary thereto, wherein the base sequence of said oligomers comprises at least one CpG dinucleotide.

It is further preferred that, where the subsequent amplification of d) is carried out by means of methylation specific primers, as described above, said methylation specific primers comprise a sequence having a length of at least 9 nucleotides which hybridizes to a treated nucleic acid sequence according to one of SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050 and sequences complementary thereto, wherein the base sequence of said oligomers comprises at least one CpG dinucleotide.

In an alternative most preferred embodiment of the method, the subsequent amplification of d) is carried out in the presence of blocking oligonucleotides, as described above. Said blocking oligonucleotides comprising a sequence having a length of at least 9 nucleotides which hybridizes to a treated nucleic acid sequence according to one of SEQ ID NOs: 60-295, 1029-1076, 1117-1120, 1172-1175 and sequences complementary thereto, wherein the base sequence of said oligomers comprises at least one CpG, TpG or CpA dinucleotide.

It is particularly preferred that said blocking oligonucleotides comprising a sequence having a length of at least 9 nucleotides which hybridizes to a treated nucleic acid sequence according to one of SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050 and sequences complementary thereto, wherein the base sequence of said oligomers comprises at least one CpG, TpG or CpA dinucleotide.

Step e) of the method, namely the detection of the specific amplificates indicative of the methylation status of one or more CpG positions according to SEQ ID NO: 1 to SEQ ID NO: 59, SEQ ID NO: 1017 to SEQ ID NO: 1028, SEQ ID NO: 1116 and SEQ ID NO:1171 is carried out by means of real-time detection methods as described above.

Additional embodiments of the invention provide a method for the analysis of the methylation status of genomic DNA according to the invention (SEQ ID NO: 1 to SEQ ID NO: 59, SEQ ID NO: 1017 to SEQ ID NO: 1028, SEQ ID NO: 1116 and SEQ ID NO:1171, and complements thereof) without the need for pretreatment.

In the first step of such additional embodiments, the genomic DNA sample is isolated from tissue or cellular sources. Preferably, such sources include cell lines, histological slides, body fluids, or tissue embedded in paraffin. In the second step, the genomic DNA is extracted. Extraction may be by means that are standard to one skilled in the art, including but not limited to the use of detergent lysates, sonification and vortexing with glass beads. Once the nucleic acids have been extracted, the genomic double-stranded DNA is used in the analysis.

In a preferred embodiment, the DNA may be cleaved prior to the treatment, and this may be by any means standard in the state of the art, in particular with methylation-sensitive restriction endonucleases.

In the third step, the DNA is then digested with one or more methylation sensitive restriction enzymes. The digestion is carried out such that hydrolysis of the DNA at the restriction site is informative of the methylation status of a specific CpG dinucleotide. In the fourth step, which is optional but a preferred embodiment, the restriction fragments are amplified. This is preferably carried out using a polymerase chain reaction, and said amplificates may carry suitable detectable labels as discussed above, namely fluorophore labels, radionuclides and mass labels.

In the fifth step the amplificates are detected. The detection may be by any means standard in the art, for example, but not limited to, gel electrophoresis analysis, hybridization analysis, incorporation of detectable tags within the PCR products, DNA array analysis, MALDI or ESI analysis.

Subsequent to the determination of the methylation state of the genomic nucleic acids the presence, absence or subclass of prostate cell proliferative disorder is deduced based upon the methylation state of at least one CpG dinucleotide sequence of SEQ ID NO: 1 to SEQ ID NO: 59, SEQ ID NO: 1017 to SEQ ID NO: 1028, SEQ ID NO: 1116 and SEQ ID NO:1171, or an average, or a value reflecting an average methylation state of a plurality of CpG dinucleotide sequences of SEQ ID NO: 1 to SEQ ID NO: 59, SEQ ID NO: 1017 to SEQ ID NO: 1028, SEQ ID NO: 1116 and SEQ ID NO:1171.

Kits

Moreover, an additional aspect of the present invention is a kit comprising, for example: a bisulfite-containing reagent; a set of primer oligonucleotides containing at least two oligonucleotides whose sequences in each case correspond, are complementary, or hybridize under stringent or highly stringent conditions to a 16-base long segment of the sequences SEQ ID NO: 1 to SEQ ID NO: 59, SEQ ID NO: 1017 to SEQ ID NO: 1028, SEQ ID NO: 1116, SEQ ID NO:1171, SEQ ID NOs: 60-295, 1029-1076, 1117-1120, 1172-1175; oligonucleotides and/or PNA-oligomers; as well as instructions for carrying out and evaluating the described method. In a further preferred embodiment, said kit may further comprise standard reagents for performing a CpG position-specific methylation analysis, wherein said analysis comprises one or more of the following techniques: MS-SNuPE, MSP, MethyLight™, HeavyMethyl™, COBRA, and nucleic acid sequencing.

It is further preferred that said comprise a bisulfite-containing reagent; a set of primer oligonucleotides containing at least two oligonucleotides whose sequences in each case correspond, are complementary, or hybridize under stringent or highly stringent conditions to a 16-base long segment of the sequences SEQ ID NO: 1043, 1044, 172, 173, 98, 99, 130, 131, 1172, 1173, 160, 161, 120, 121, 106, 107, 80, 81, 1051, 1052, 66, 67, 1117, 118, 1045, 1046, 1035, 1036, 94, 95, 1033, 1034, 1049, 1050; oligonucleotides and/or PNA-oligomers; as well as instructions for carrying out and evaluating the described method. In a further preferred embodiment, said kit may further comprise standard reagents for performing a CpG position-specific methylation analysis, wherein said analysis comprises one or more of the following techniques: MS-SNuPE, MSP, MethyLight™, HeavyMethyl™, COBRA, and nucleic acid sequencing.

However, a kit along the lines of the present invention can also contain only part of the aforementioned components.

While the present invention has been described with specificity in accordance with certain of its preferred embodiments, the following examples serve only to illustrate the invention and are not intended to limit the invention within the principles and scope of the broadest interpretations and equivalent configurations thereof.

EXAMPLES

In the following EXAMPLES, 'uL' is taken to mean 'microliter' i.e. $10^{-6}$ liters, accordingly 'uM' is taken to mean 'micromolar'.

Pooled genomic DNA was isolated and analyzed using the discovery methods, AP-PCR and MCA (Example 1). These technologies distinguish between methylated and unmethylated CpG sites through the use of methylation sensitive enzymes. In general, whole genomic DNA is first digested to increase manageability, and then further digested with a methylation sensitive restriction enzyme. Methylated fragments are preferentially amplified because cleavage at the unmethylated sites prevents amplification of these products. Differentially methylated fragments identified using these techniques are sequenced (Example 2) and compared to the human genome using the BLAST utility in the Ensembl database. The sample set was selected based on the initial aim of the diagnostic problem to be solved, namely the improved detection and discrimination of prostate carcinomas from normal or benign conditions. The following comparisons were run using three "All Cancer" prostate cancer sample pools (10, 10, and 20 samples each), two benign prostate hyperplasia (BPH) sample pools (10 samples each), three low grade prostate cancer sample pools (10 samples each), three high grade prostate cancer sample pools (10 samples each), and one peripheral blood lymphocytes (PBL) pool (9 samples)]:

BPH vs. All Cancer (High & low Gleason score; transitional (TZ) and peripheral (PZ) zones, 2 comparisons)
BPH vs. Low Gleason Score (Gleason <6, TZ & PZ represented, 2 comparisons)
BPH vs. High Gleason Score (Gleason >7, TZ & PZ represented, 2 comparisons)
Low Gleason Score vs. High Gleason Score (for MCA, each pool was used as tester and driver)
BPH vs. PBLs
All cancer vs. PBLs The BPH vs. PBLs comparison was not done for APPCR.

For all MCA comparisons that included cancer samples, the cancer was the tester. The low to high Gleason score comparison was run twice, once with low as the tester, and once with high as the tester, bringing the total number of comparisons for MCA to ten. In the experiments with PBLs, the PBL sample was the driver. See Table 1.

Example 1

MCA and AP-PCR

The aim of the following investigation was to identify one or more primary differentially methylated CpG dinucleotide sequences using a controlled assay suitable for identifying at least one differentially methylated CpG dinucleotide sequence within the entire genome, or a representative fraction thereof.

All processes were performed on both pooled and/or individual samples, and analysis was carried out using two different Discovery methods; namely, methylated CpG amplification (MCA), and arbitrarily-primed PCR (AP-PCR).

AP-PCR. AP-PCR analysis was performed on sample classes of genomic DNA as follows:

1. DNA isolation; genomic DNA was isolated from sample classes using the commercially available Wizard™ kit;
2. Restriction enzyme digestion; each DNA sample pool was digested with 3 different sets of restriction enzymes for 16 hours at 37° C.: RsaI (recognition site: GTAC); RsaI (recognition site: GTAC) plus HpaII (recognition site: CCGG; sensitive to methylation); and RsaI (recognition site: GTAC) plus MspI (recognition site: CCGG; insensitive to methylation);
3. AP-PCR analysis; each of the restriction digested DNA samples was amplified with the primers listed in TABLE 2 at a 40° C. annealing temperature, and with $^{33}$P DATP in the primer sets outlined in Table 3.
4. Polyacrylamide Gel Electrophoresis; 1.6 □l of each AP-PCR sample was loaded on a 5% Polyacrylamide sequencing-size gel, and electrophoresed for 4 hours at 130 Watts. Gels were transferred to chromatography paper, covered with saran wrap, and dried in a gel dryer for a period of about 1-hour.
5. Autoradiographic Film Exposure; film was exposed to dried gels for 20 hours at minus 80° C., and then developed.

TABLE 1

Sample pools used in comparison studies (AP-PCR and MCA)

| | | | | | Sample Breakdown | | | |
|---|---|---|---|---|---|---|---|---|
| Comparison | Nickname | Pool Type | Pool # | Samples per pool | Gleas <6/ Trans. Zone | Gleas <6/ Periph Zone | Gleas >7 Trans. Zone | Gleas >7 Periph Zone |
| BPH vs. All cancers | BA1 | BPH | 1 | 10 | | 10 BPH | | |
| | | All | 1 | 10 | 2 | 3 | 2 | 3 |
| BPH vs. All cancers | BA2 | BPH | 2 | 10 | | 5 BPH, 5 Normal | | |
| | | All | 2 | 10 | 3 | 2 | 3 | 2 |
| BPH vs. Low | BL1 | BPH | 1 | 10 | | 10 BPH | | |
| | | Low | 1 | 10 | 5 | 5 | 0 | 0 |
| BPH vs. Low | BL2 | BPH | 2 | 10 | | 5 BPH, 5 Normal | | |
| | | Low | 2 | 10 | 5 | 5 | 0 | 0 |
| BPH vs. High | BH1 | BPH | 1 | 10 | | 10 BPH | | |
| | | High | 1 | 10 | 0 | 0 | 5 | 5 |
| BPH vs. High | BH2 | BPH | 2 | 10 | | 5 BPH, 5 Normal | | |
| | | High | 2 | 10 | 0 | 0 | 5 | 5 |
| Low vs. High | HL | Low | 3 | 10 | 5 | 5 | 0 | 0 |
| | | High | 3 | 10 | 0 | 0 | 5 | 5 |
| BPH vs. PBLs | BP | BPH | 1 | 10 | | 10 BPH | | |
| | | PBL | 1 | 9 | | 9 PBL's | | |
| Cancer vs. PBL | CP | All | 3 | 20 | 5 | 5 | 5 | 5 |
| | | PBL | 1 | 9 | | 9 PBL's | | |

Glogos II Autorad markers (Stratagene) were added to the dried gel and exposure was repeated with new film. The first autorad was retained for records, while the second was used for excising bands; and 6. Bands corresponding to differential methylation were visually identified on the gel. Such bands were excised and the DNA therein was isolated and cloned using the Invitrogen TA Cloning Kit.

TABLE 2

Primers used according to the AP-PCR Protocol Example 1

| Name | SEQ ID NO: | Sequence |
|---|---|---|
| GC1 | 928 | GGGCCGCGGC |
| GC2 | 929 | CCCCGCGGGG |
| GC3 | 930 | CGCGGGGGCG |
| GC4 | 931 | GCGCGCCGCG |
| GC5 | 932 | GCGGGGCGGC |
| G1 | 933 | GCGCCGACGT |
| G2 | 934 | CGGGACGCGA |
| G3 | 935 | CCGCGATCGC |
| G4 | 936 | TGGCCGCCGA |
| G5 | 937 | TGCGACGCCG |
| G6 | 938 | ATCCCGCCCG |
| G7 | 939 | GCGCATGCGG |
| G8 | 940 | GCGACGTGCG |
| G9 | 941 | GCCGCGNGNG |
| G10 | 942 | GCCCGCGNNG |
| APBS1 | 943 | AGCGGCCGCG |
| APBS5 | 944 | CTCCCACGCG |
| APBS7 | 945 | GAGGTGCGCG |
| APBS10 | 946 | AGGGGACGCG |
| APBS11 | 947 | GAGAGGCGCG |
| APBS12 | 948 | GCCCCCGCGA |
| APBS13 | 949 | CGGGGCGCGA |
| APBS17 | 950 | GGGGACGCGA |
| APBS18 | 951 | ACCCCACCCG |

TABLE 3

| Combination | primer 1 | primer 2 | primer 3 |
|---|---|---|---|
| 101 | GC1 | G2 | APBS1 |
| 103 | GC3 | G4 | APBS1 |
| 105 | GC5 | G6 | APBS1 |
| 107 | GC2 | G8 | APBS5 |
| 109 | GC4 | G10 | APBS5 |
| 111 | GC1 | G8 | APBS7 |
| 113 | GC3 | G6 | APBS7 |
| 115 | GC5 | G4 | APBS7 |
| 117 | GC2 | G2 | APBS10 |
| 119 | GC4 | G2 | APBS10 |
| 121 | GC1 | G4 | APBS11 |
| 123 | GC3 | G5 | APBS11 |
| 125 | GC5 | G7 | APBS11 |
| 127 | GC2 | G9 | APBS12 |
| 129 | GC4 | G9 | APBS12 |
| 131 | GC1 | G7 | APBS13 |
| 133 | GC3 | G5 | APBS13 |
| 135 | GC5 | G3 | APBS13 |
| 137 | GC2 | G1 | APBS17 |
| 139 | GC4 | G3 | APBS17 |
| 141 | GC1 | G5 | APBS18 |
| 143 | GC3 | G7 | APBS18 |
| 145 | GC5 | G9 | APBS18 |
| 147 | G2 | G3 | APBS17 |
| 149 | G4 | G5 | APBS17 |
| 151 | G6 | G7 | APBS17 |
| 153 | G8 | G9 | APBS13 |
| 155 | G8 | G10 | APBS13 |
| 157 | G6 | G8 | APBS12 |
| 159 | G4 | G6 | APBS12 |
| 161 | G2 | G4 | APBS12 |
| 163 | G2 | G10 | APBS11 |
| 165 | G2 | G5 | APBS11 |
| 167 | G4 | G7 | APBS10 |
| 169 | G6 | G9 | APBS10 |
| 171 | G1 | G8 | APBS10 |
| 173 | G6 | G10 | APBS7 |
| 175 | G4 | G8 | APBS7 |
| 177 | G2 | G6 | APBS5 |
| 179 | G4 | G10 | APBS5 |
| 181 | G2 | G8 | APBS5 |
| 183 | APBS1 | APBS10 | APBS11 |
| 185 | APBS5 | APBS7 | APBS17 |
| 187 | APBS1 | APBS12 | APBS18 |
| 189 | APBS10 | APBS13 | APBS17 |
| 191 | APBS5 | APBS11 | APBS12 |
| 193 | APBS7 | APBS10 | APBS13 |
| 195 | APBS1 | APBS5 | APBS11 |
| 197 | APBS7 | APBS17 | APBS18 |
| 199 | APBS1 | APBS12 | APBS13 |

MCA. MCA was used to identify hypermethylated sequences in one population of genomic DNA as compared to a second population by selectively eliminating sequences that do not contain the hypermethylated regions. This was accomplished, as described in detail herein above, by digestion of genomic DNA with a methylation-sensitive enzyme that cleaves un-methylated restriction sites to leave blunt ends, followed by cleavage with an isoschizomer that is methylation insensitive and leaves sticky ends. This is followed by ligation of adaptors, amplicon generation and subtractive hybridization of the tester population with the driver population.

The initial restriction digestion reaction solutions contained the following:

Drivers:

| DNA | 510 uL |
|---|---|
| buffer 4 | 60 uL |
| 100x BSA | 6 uL |
| SmaI (20 U/uL) | 24 uL |

Testers:

| DNA | 68 uL |
|---|---|
| buffer 4 | 10 uL |
| 10x BSA | 10 uL |
| SmaI (20 U/uL) | 2 uL |

The reaction mixtures were incubated overnight at room temperature.

The pools were then further digested with XmaI (2 uL=100 U), 6 hours at 37° C. 2 uL (20 U) XmaI was added to each tester digest and 8 uL (80 U) to each driver digest The cleaned-up, digested material was ligated to the adapter-primer RXMA24+RXMA12 (Sequence: RXMA24: AGCACTCTCCAGCCTCTCACCGAC (SEQ ID NO: 952); RXMA12: CCGGGTCGGTGA (SEQ ID NO:953). These were hybridized to create the adapter by heating together at 70° C. and slowly cooling to room temperature (RT) in a 30 uL reaction:

| Each DNA | 33 uL |
|---|---|
| T4 Buffer | 6 uL |
| RXMA adapter-primer (100 uM) | 20 uL |
| Ligase | 1 uL |

The reaction solution was incubated overnight at room temperature.

3 uL of the ligation mix for both tester and driver populations was used in each initial PCR to generate the starting amplicons. The reaction solutions were as follows:
Testers:

| 100 uM RXMA24 | 1 uL |
|---|---|
| PCR buffer | 10 uL |
| 25 mM dNTPs | 1.2 uL |
| ddH20 | 68.8 uL |
| Titanium Taq | 1 uL |
| 100% DMSO | 2 uL |
| 5M Betaine | 10 uL |

3 uL ligated tester DNA was added to each 97 uL tester cocktail.
Drivers:
Drivers are amplified with dUTP in place of dTTP:

| 100 uM RXMA24 | 1 uL |
|---|---|
| PCR buffer | 10 uL |
| 25 mM dNTPs | 1.2 uL (25 mM each dATP, dCTP, dGTP, and dUTP) |
| ddH20 | 68.8 uL |
| Titanium Taq | 1 uL |
| 100% DMSO | 2 uL |
| 5M Betaine | 10 uL |

3 uL ligated driver DNA was added to each 97 uL driver cocktail.
PCR Conditions:
72 degrees 5 min
30 cycles:
95 degrees 1 min
72 degrees 3 min
Final Extension:
72 degrees 10 min.

The tester amplicons were then digested with XmaI, yielding overhanging ends, and the driver amplicons were digested with SmaI yielding blunt end fragments.
Drivers (SmaI):

| DNA | 500 uL |
|---|---|
| Buffer 4 | 100 uL |
| 100x BSA | 10 uL |
| H20 | 340 uL |
| SmaI (20 U/uL) | 50 uL |
| Total vol: | 1 mL. Incubated overnight at room temp. |

Testers (XmaI):

| DNA | 20 uL |
|---|---|
| buffer 4 | 10 uL |
| 10x BSA | 10 uL |
| H20 | 59 uL |
| XmaI (50 U/uL) | 1 uL |
| Total vol: | 100 uL. Incubated overnight at 37 degrees. |

A new set of adapter primers (hybridized as described for the above RXMA primers) JXMA24+MA12 (Sequence: JXMA24: ACCGACGTCGACTATCCATGAACC(SEQ ID NO:954); JXMA12: CCGGGGTTCATG (SEQ ID NO:955) was ligated to the Tester in a Thermocycler at 16° C. for 2 hours in the following reaction solution:

| DNA | 16 uL |
|---|---|
| T4 buffer | 3 uL |
| JXMA-P adapter (100 uM) | 10 uL |
| T4 Ligase (400 U/uL) | 1 uL |

The digested tester and driver amplicons were hybridized together. A selective PCR reaction was done using primer JXMA24 (SEQ ID NO:954). The reaction solution contained:

| JXMA24 | 0.5 uL |
|---|---|
| taq buffer | 5 uL |
| dNTPs | 0.6 uL |
| ddH20 | 27.4 uL |
| betaine | 5 uL |
| DMSO | 1 uL |
| Titanium taq | 0.5 uL |
| DNA | 10 uL |

PCR Conditions:
72 degrees 8 min (fill in ends)
5 cycles:
95 degrees 1 min
72 degrees 3 min
Final Extension:
72 degrees 10 min Subsequently, 20 uL of Mung Bean nuclease buffer plus 10 uL Mung Bean Nuclease (10 U) was added and incubated at 37° C. for 30 minutes. This reaction was cleaned up and used as a template for 25 more cycles of PCR using JXMA24 primer in the following reaction solution:

| JXMA24 | 1 uL |
|---|---|
| taq buffer | 10 uL |
| dNTPs | 1.2 uL |
| ddH20 | 27 uL |
| betaine | 10 uL |
| DMSO | 2 uL |
| Titanium taq | 1 uL |
| DNA | 48 uL | under the following conditions.
95 degrees 2 min
30 cycles:
95 degrees 1 min
72 degrees 3 min
Final Extension:
72 degrees 10 min
Hold at 4 degrees The Resulting PCR Product (Tester) was Digested again Using XmaI:
45 uL DNA
15 uL Buffer 4
15 uL 10×BSA
71 uL H20
4 uL XmaI
Incubated overnight at 37 degrees A third adapter, NXMA24 (AGGCAACTGTGCTATCCGAGTGAC; SEQ ID NO:956) +NXMA12 (CCGGGTCACTCG; SEQ ID NO: 957) was ligated. The tester (500 ng) was hybridized a second time to the original digested driver (40 ug) in 4 uL EE (30 mM EPPS, 3 mM EDTA) and 1 uL 5 M NaCl at 67° C. for 20 hours. Selective PCR was performed using NXMA24 primer as follows:

| | |
|---|---|
| NXMA24 | 0.5 uL |
| taq buffer | 5 uL |
| dNTPs | 0.6 uL |
| ddH20 | 27.4 uL |
| betaine | 5 uL |
| DMSO | 1 uL |
| Titanium taq | 0.5 uL |
| DNA | 10 uL |

PCR Program:
72 degrees 8 min (fill in ends)
8 cycles:
95 degrees 1 min
72 degrees 3 min
Final Extension:
72 degrees 10 min
The reaction solution was held at 4 degrees Subsequently, 20 uL of Mung Bean nuclease buffer plus 10 uL Mung Bean Nuclease (10 U) was added and incubated at 30° C. for 30 minutes. This reaction was cleaned up and used as a template for 25 more cycles of PCR using NXMA24 primer as follows:
Reaction Solution

| | |
|---|---|
| NXMA24 | 1 uL |
| taq buffer | 10 uL |
| dNTPs | 1.2 uL |
| ddH20 | 27 uL |
| betaine | 10 uL |
| DMSO | 2 uL |
| Titanium taq | 1 uL |
| DNA | 48 uL |

PCR Program:
95 degrees 2 min
30 cycles:
95 degrees 1 min
72 degrees 3 min
Final Extension:
72 degrees 10 min
Hold at 4 degrees
The Resulting PCR Product was Digested with XmaI:
Reaction Solution:

| | |
|---|---|
| DNA | 38 uL |
| buffer 4 | 5 uL |
| 10x BSA | 5 uL |
| Xma I | 2 uL |

Incubated overnight at 37 degrees.
The DNA digest was then ligated into the vector pBC Sk—predigested with XmaI and phosphatased (675 ng). 5 uL of the ligation mixture was used to transform chemically competent TOP10™ cells according to the manufacturer's instructions. The transformations were plated onto LB/XGal/IPTG/CAM plates. Selected insert colonies were sequenced according to Example 2.

Example 1 resulted in a large number of unique sequences that were potential candidates for assay markers. A subset of these sequences was eliminated due their high (>50%) repeat content. A total of 480 unique sequences were identified in the comparisons performed for this study. A subset of these sequences were further selected using the following scoring procedure:

Appearance using multiple methods
Appearance in multiple pools
Located within CpG island
Located within the promoter region of a gene
Near or within predicted or known gene
Known to be associated with disease
Class of gene (transcription factor, growth factor, etc.)
Repetitive element (negative score)

Under this scoring scheme, a MeST sequence receives a point for each of the above criteria, and receives a score of (−)8 for having repetitive sequence content greater than 50%. The highest score possible is 7, the lowest is (−)8. Scores are automatically generated using a proprietary database. Of the initial set of 480 MeST sequences, 277 scored 0 or higher. Using the scoring criteria above, along with manual review of the sequences, the number of candidate MeST was further reduced to 126 unique sequences.

Primer design for the 126 sequences was then initiated for the purpose of bisulfite sequencing. Thirty five of the sequences were discarded for various reasons including inability to design adequate primers, failure of amplification from control DNA, or if further scrutiny of the sequence or updates of the Ensembl database revealed poor quality or repeat sequences not previously noted.

Example 2

Bisulfite Sequencing

For bisulfite sequencing amplification primers were designed to cover each identified MeST sequence when possible or part of the 1000 bp upstream or 1000 bp downstream flanking regions surrounding the position. Samples used in Example 1 were utilized for amplicon production in this phase of the study. Each sample was treated with sodium bisulfite and sequenced. Sequence data was obtained using ABI 3700 sequencing technology. Obtained sequence traces were normalized and percentage methylation calculated using Epigenomic's proprietary ESME bisulphite sequence sequencing trace analysis program.

Results of Bisulfite Sequencing

The Following Properties were Noted:
1. Bisulfite sequencing indicates differential methylation of a CpG site between selected classes of samples (fisher score)
2. Co-methylation is observed
3. if only one site has Fisher score >1, are there additional sites surrounding with fisher score >0.5?

Genomic regions that were considered to demonstrate significant co-methylation as assesed by these criteria then proceeded to further investigation.

Figure 3:

FIGS. 1 to 3 are ranked matrices produced from bisulfite sequencing data analysed by the Epigenomics' proprietary software (See WO 2004/000463 for further information). The overall matrix represents the sequencing data for one region of interest. Each row of the matrix represents a single CpG site within the fragment and each column represents an individual DNA sample. The bar on the left represents a scale of the percent methylation, with the degree of methylation represented by the shade of each position within the column from black representing 100% methylation to light grey representing 0% methylation. White positions represented a measurement with no data available.

FIG. 1 shows the sequencing data of a fragment of the gene Prostaglandin E2. Receptor, EP4 Subtype. Here, bisulfite sequencing showed differential but non-conclusive patterns of methylation between samples. The gene was further investigated on a larger sample set using the array process (Example 3) as the accuracy of this gene as a marker could be improved when analysed in combination with other genes.

FIG. 2 shows the sequencing data of a fragment of the gene Orphan Nuclear Receptor (alpha-1Fetoprotein Transcription Factor). In this case, bisulfite sequencing indicated differential methylation or comethylation between sample types.

FIG. 3 shows the sequencing data of a fragment of the gene 1-Acyl-SN-Glycerol-3-Phosphate Acyltransferase Gamma. This was representative of a subset of ROIs for which only poor quality sequence reads were obtained and the gene was only able to be meaningfully analysed using the array process (Example 3).

Example 3

Array Analysis

A selection of the differentially methylated genomic regions were further analysed by means of high throughput array analysis. The most useful final assay suitable for a diagnostic/classification screening test would enable analysis of body fluids such as serum, plasma or urine sediment (obviating the need for invasive procedures). Therefore, the sample set included DNA samples from other cancers which may be present in blood to provide more specific marker sets for sensitive assays.
//
//

Description of Sample Set for Chip Study

The sample set for the microarray analysis was designed to provide information concerning both the sensitivity and specificity of the marker candidates. A large number of samples (Table 7) from prostate cancer, BPH and normal prostate were screened. Prostate cancer samples were grouped by Gleason Score (High (≥8), Moderate (7), and Low (≤6)) and by zone (peripheral or transitional). The distribution of BPH samples was random, but because most BPH is derived from the transitional zone, it can be assumed that most samples were of that origin. In addition to prostate samples, a number of other cancer types were included to test for specificity to the prostate. PBL samples were included to analyze the potential use of these markers in a blood based screen. Normal liver and liver cancer were also included because of the observed methylation of GSTP1 in these samples.

TABLE 7

Overview of samples for the array study.
Sample Type

Prostate Cancers

High Grade (Gleason ≥8)
Transitional Zone
Peripheral Zone
Low Grade (Gleason ≤6)
Transitional Zone
Peripheral Zone
Moderate Grade
(Gleason = 7)
Transitional Zone
Peripheral Zone
Additional Prostate
Cancers
Post hormone therapy
Benign Prostate Disease BPH
Benign Fibroma
Prostatitis
Genitourinary Tract
Cancers Bladder
Testicular
Kidney
Endocrine Related Cancers Breast
Male
Female
Ovarian
Uterine
Other Cancers Liver
Lung
Esophageal
Salivary Gland
Stomach
Pancreatic
Melanoma
Colon
Other Normal tissues Prostate
Transitional
Peripheral
Bladder
Kidney
Liver
Testes
Sperm
Ureter
PBLs DNA Extraction Samples were received from either as frozen tissue or extracted genomic DNA. All DNA samples were extracted using Qiagen Genomic Tip-500 columns or the MagnaPure device.

Bisulfite Treatment and Multiplex PCR

Total genomic DNA of all samples was bisulfite treated to convert umnethylated cytosines to uracil. Methylated cytosines remained conserved as cytosines. Bisulfite treatment was performed using Epigenomics' proprietary bisulfite treatment process. Two independent bisulfite reactions were performed per patient sample. After bisulfitation 10 ng of each DNA sample was used in subsequent multiplex PCR (MPCR) reactions containing 7-8 primer pairs.

Hybridization

Each Reaction Contained the Following:
0.4 mM each DNTPS
1 Unit Taq Polymerase
2.5 ul PCR buffer
3.5 mM MgCl2
80 nM Primerset (12-16 primers)
11.25 ng DNA (bisulfite treated)
Further details of the primers are shown in TABLE 8.

Forty cycles were carried out as follows: Denaturation at 95° C. for 15 min, followed by annealing at 55° C. for 45 sec., primer elongation at 65° C. for 2 min. A final elongation at 65° C. was carried out for 10 min.

Hybridization

All PCR products from each individual sample were then hybridised to glass slides carrying a pair of immobilised oligonucleotides for each CpG position under analysis. Each of these detection oligonucleotides was designed to hybridize to the bisulphite converted sequence around one CpG site which was either originally unmethylated (TG) or methylated (CG). See Table 2 for further details of all hybridization oligonucleotides used (both informative and non-informative). Hybridization conditions were selected to allow the detection of the single nucleotide differences between the TG and CG variants.

5 ul volume of each multiplex PCR product was diluted in 10×SSARC buffer. The reaction mixture was then hybridized to the detection oligonucleotides as follows. Denaturation at 95° C., cooling down to 10° C., hybridization at 42° C. overnight followed by washing with 10×SSARC and dH$_2$O at 42° C.

Further details of the hybridization oligonucleotides are shown in TABLE 9.

Fluorescent signals from each hybridized oligonucleotide were detected using genepix scanner and software. Ratios for the two signals (from the CG oligonucleotide and the TG oligonucleotide used to analyse each CpG position) were calculated based on comparison of intensity of the fluorescent signals.

For each patient, 2 DNA aliquots were bisulfite treated and for each bisulfite treated DNA sample two hybridizations were performed, resulting in a total of 4 chips processed per patient. For hybridization, the samples were grouped into 2 processing rounds in order to avoid a potential process-bias. As stated, each of the 2 rounds included a 2 fold redundancy for each DNA sample for the 4-fold redundancy per patient. The samples were hybridized in batches of 112 samples randomized for sex, diagnosis, tissue, and bisulfite batch.

Data Analysis Methods:

Analysis of the Chip Data

For the analysis of the chip data Epigenomics' proprietary software "EpiScape®" was used. It encompasses a variety of statistical tools and novel machine learning methods for analyzing and visualizing methylation array data. In the following sections we summarize the most important data analysis techniques that we applied for analyzing the data.

From Raw Hybridization Intensities to Methylation Ratios

The log methylation ratio (log(CG/TG)) at each CpG position is determined according to a standardized preprocessing pipeline. This log ratio has the property that the hybridization noise has approximately constant variance over the full range of possible methylation rates.

Hypothesis Testing

Our main task was to identify markers that can make a significant contribution to the class prediction of samples. For the 'particularly preferred embodiments' of the invention the significant contribution was detected when the null-hypothesis that a prediction model including the marker does not improve classification performance over a model without the marker could be rejected with $p<0.05$. Because we applied this test to a whole set of potential markers, we corrected the p-values for multiple testing. We did this by applying the conservative Bonferroni correction, which simply multiplies the single marker p-values with the number of potential markers tested. We also gave results with the less conservative False Discovery Rate (FDR) method.

Throughout this example a marker (sometimes also simply referred to as gene or amplicon) is also referred to as a genomic region of interest (ROI). It comprises of several CpG positions in the respective genomic region. For testing the null hypothesis that a marker has no predictive power we used the likelihood ratio test for logistic regression models. The logistic regression model for a single marker is a linear combination of methylation measurements from all CpG positions in the respective ROI. The fitted logistic regression model is compared to a constant probability model that is independent of methylation and represents the null hypothesis. The p-value of the marker was computed via the likelihood ratio test.

A significant p-value for a marker means that the methylation of this ROI has some systematic correlation to the question of interest as given by the two classes. In general a significant p-value does not necessarily imply a good classification performance. However, because with logistic regression we used a linear predictor as the basis of our test statistic small p-values are indicative of a good clinical performance.

Class Prediction by Supervised Learning

To give a reliable estimate of how well the CpG ensemble of a selected marker can differentiate between different tissue classes we can determine its prediction accuracy by classification. For that purpose we calculated a methylation profile-based prediction function using a certain set of tissue samples with a specific class label. This step is called training and it exploits the prior knowledge represented by the data labels. The prediction accuracy of that function was then tested on a set of independent samples. As a method of choice, we used the support vector machine (SVM) algorithm to learn the prediction function. In this analysis, sensitivity and specificity were weighted equally. This was achieved by setting the risk associated with false positive and false negative classifications to be inversely proportional to the respective class sizes. Therefore sensitivity and specificity of the resulting classifier could be expected to be approximately equal. Note that this weighting can be adapted according to the clinical requirements.

Estimating the Performance of the Tissue Class Prediction: Cross Validation

With limited sample size the cross-validation method provided an effective and reliable estimate for the prediction accuracy of a discriminator function, and therefore in addition to the significance of the markers we provided cross-validation accuracy, sensitivity and specificity estimates. For each classification task, the samples were partitioned into 5 groups of approximately equal size. Then the learning algorithm was trained on 4 of these 5 sample groups. The predictor obtained by this method was then tested on the remaining group of independent test samples. The number of correct positive and negative classifications was counted over 10 runs for the learning algorithm for all possible choices of the independent test group without using any knowledge obtained from the previous runs. This procedure was repeated on 10 random permutations of the sample set giving a better estimate of the prediction performance than if performed by simply splitting the samples into one training sample set and one independent test set.

Data Analysis Results

Figure 4:
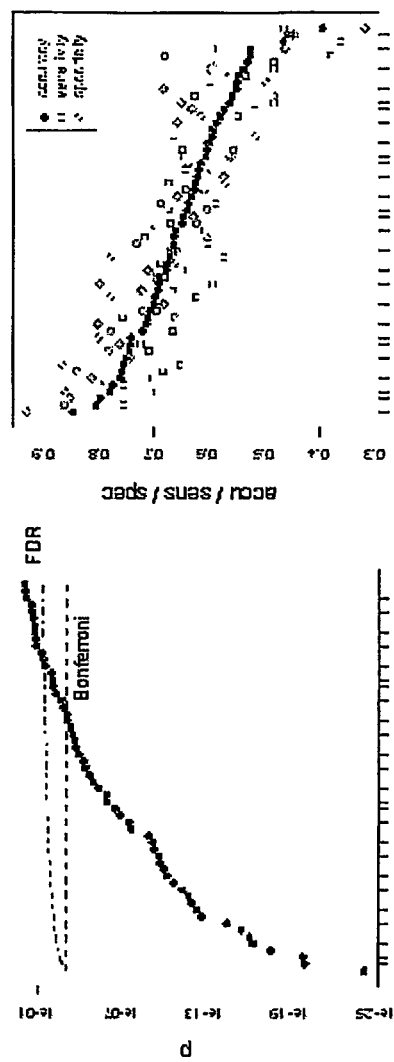
FIG. 4 shows Normal prostate and BPH vs. Prostate Cancer marker rankings according to Example 3. Each individual genomic region of interest is represented as a point. The left plot gives uncorrected p-values from the genewise logistic regression model. Lower and upper dotted lines show 5% Bonferroni and FDR limits respectively. The X-axis shows the p values for the individual CpG positions. The p values are the probabilities that the observed distribution occurred by chance in the data set. The right plot gives accuracy, sensitivity and specificity of a linear SVM trained on methylation measurements from all oligonucleotides. The accuracy of each genomic region is represented as black squares, the specificity as unfilled diamonds, the sensitivity as unfilled squares. The accuracy as measured on the X-axis shows the fraction of correctly classified samples.

Our first step in analysis of the array data was to look at discriminatory markers in a comparison of all tissues of prostatic origin. We first compared normal and BPH prostate tissue against prostate cancer samples, and found that many of the markers used in this study have p-values meeting the desired criteria (FIG. 4). Next, we compared prostate cancer tissues to all other tissue classes used in this study (Table 7). Almost all markers met the specified statistical criteria with this sample set. The GSTP1 gene is known to be hypermethylated in prostate cancer, but also displays hypermethylation in other cancers. Therefore, our final comparison was a more detailed examination of the methylation levels in prostate cancer versus other cancer types.

Prostate Normal and BPH vs. Prostate Cancer

Figure 5:
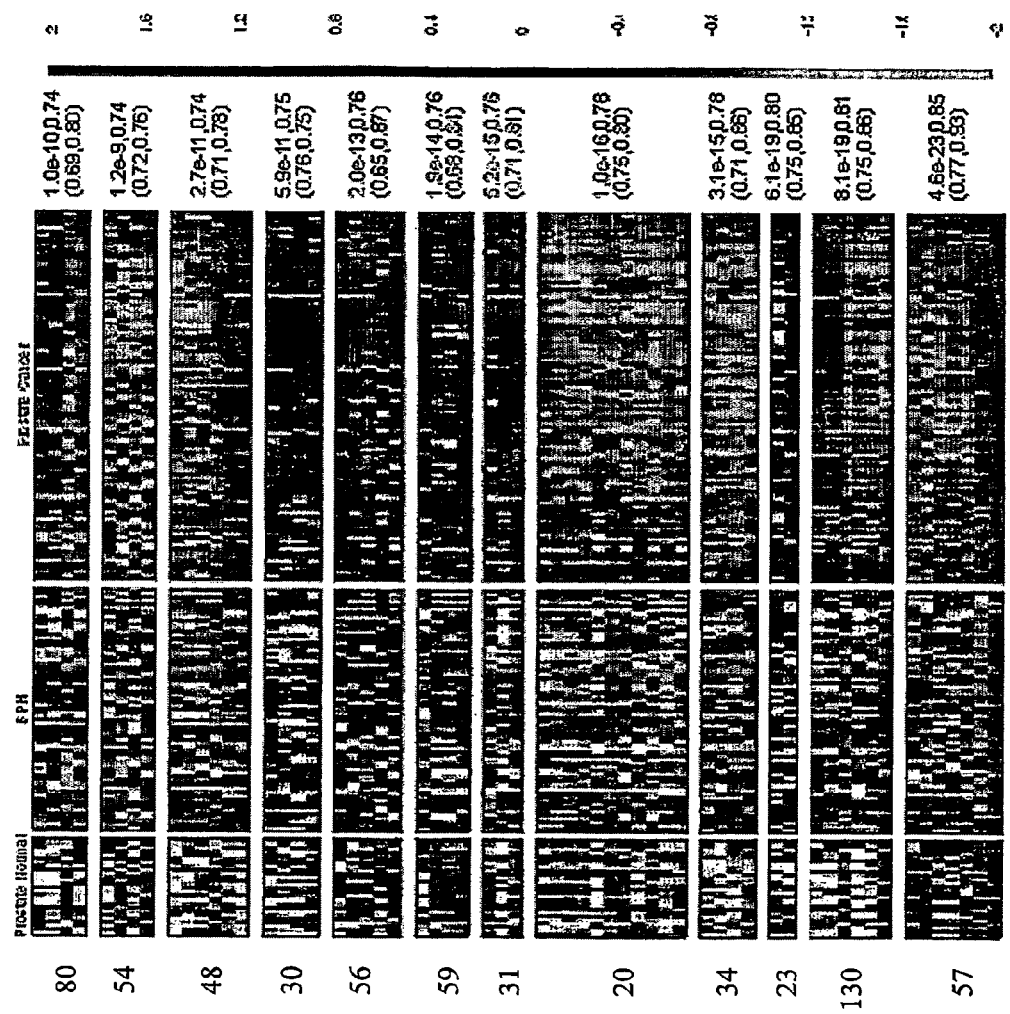
FIG. 5 shows the best 12 markers for Normal prostate and BPH vs. Prostate Cancer differentiation according to Example 3. Normal prostate and BPH samples are shown on the left. Prostate cancer is on the right. Each column represents one sample; each row one oligonucleotide. Oligonucleotides are grouped by candidate marker. The indicated markers are ordered from top to bottom with increasing accuracy. On the right side of each marker, Bonferroni corrected p-values are listed. Methylation data are centered and normalized to one standard deviation for individual oligonucleotides. The color represents the relative distance of the oligonucleotide methylation status from the mean value. Green color represents hypomethylated CpGs within an oligonucleotide while red indicates hypermethylated CpGs within an oligonucleotide.

In this comparison, the negative class consisted of 91 samples from normal prostate, and BPH. The positive class consisted of 99 prostate cancer samples. Most of the markers met the criteria of p-value<0.05 (FIG. 4). The p-values, accuracy, sensitivity and specificity of the analysis are shown in Table 4. The best 12 markers are further shown in FIG. 5.

Prostate Normal and Other Tissues vs. Prostate Cancer

Figure 6:
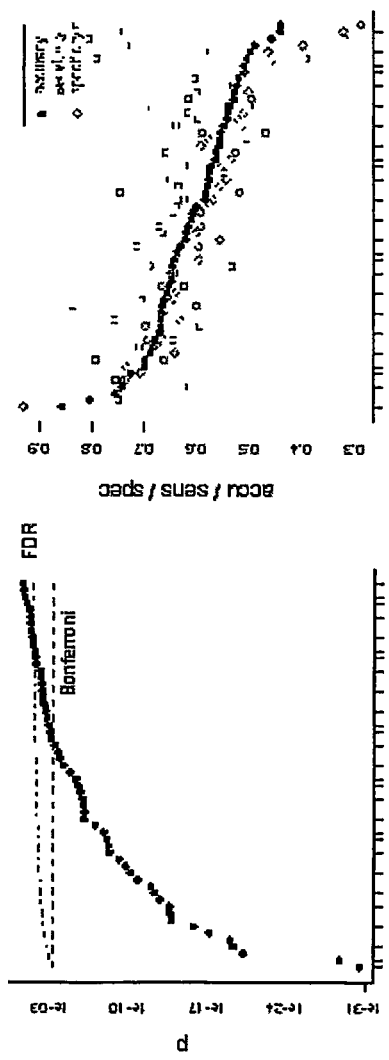
FIG. 6 shows Normal Prostate, BPH and Other Tissues vs. Prostate Cancer marker rankings according to Example 3. Each individual genomic region of interest is represented as a point. The left plot gives uncorrected p-values from the genewise logistic regression model. Lower and upper dotted lines show 5% Bonferroni and FDR limits respectively. The X-axis shows the p values for the individual CpG positions. The p values are the probabilities that the observed distribution occurred by chance in the data set. The right plot shows accuracy, sensitivity and specificity of a linear SVM trained on methylation measurements from all oligonucleotides. The accuracy of each genomic region is represented as black squares, the specificity as unfilled diamonds, the sensitivity as unfilled squares. The accuracy as measured on the X-axis shows the fraction of correctly classified samples.
Figure 7:
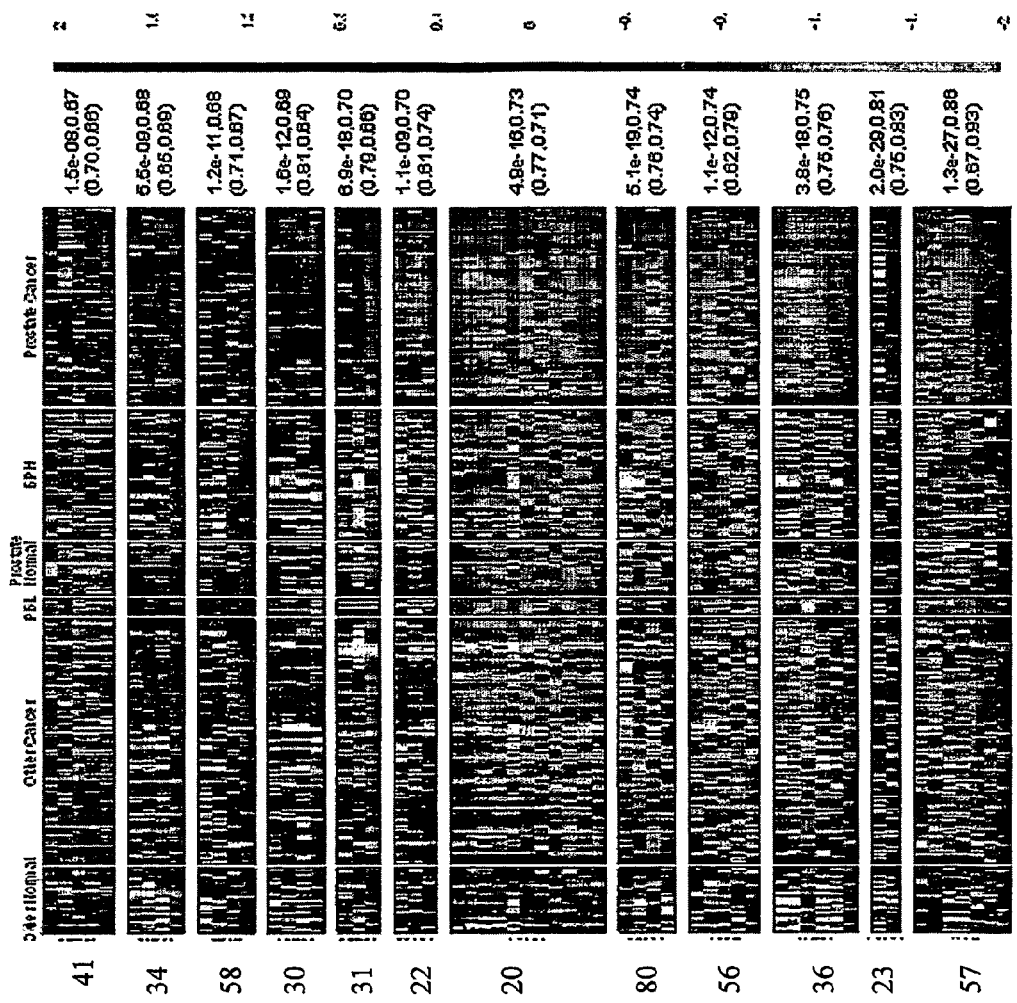
FIG. 7 shows the best 12 markers for Normal Prostate, BPH and Other Tissues vs. Prostate Cancer differentiation according to Example 3. Normal Prostate, BPH and Other Tissues samples are shown on the left. The 'Other Tissues' included normal tissue from other organs and cancer of other origins than prostate, according to table 7. Prostate cancer is on the right. Each column represents one sample; each row one oligonucleotide. Oligonucleotides are grouped by candidate marker. The indicated markers are ordered from top to bottom with increasing accuracy. On the right side of each marker, Bonferroni corrected p-values are listed. Methylation data are centered and normalized to one standard deviation for individual oligonucleotides. The color represents the relative distance of the oligonucleotide methylation status from the mean value. Green color represents hypomethylated CpGs within an oligonucleotide while red indicates hypermethylated CpGs within an oligonucleotide.

Comparisons were then performed on the complete sample set. The negative group was expanded to include normal tissue from other organs and cancer of other origins than prostate, according to TABLE 7. The negative class consists of 254 samples from normal prostate, BPH and other normal and cancerous tissues. The positive class consists of 99 prostate cancer samples. Again the p-values for most markers meet the significance level of p=<0.05 (Table 5). The accuracy of the highest performing marker is ~86% (see FIG. 6 and/or Table 5). The p-values, accuracy, sensitivity and specificity of the analysis are shown in Table 5. The best 12 markers are further shown in FIG. 7.

Other Cancers vs. Prostate Cancer

Since hypermethylation of GSTP1 (state of the art methylation prostate cancer marker) is not specific to the prostate, we examined the methylation status of prostate cancer and other cancers in greater detail. FIG. 16 shows that GSTP1 (SEQ ID NO:57) was strongly hypermethylated in liver cancer and to a lesser degree in breast cancer. Nevertheless, several other of the best candidate markers distinguish well between cancer of the prostate and liver. The p-values, accuracy, sensitivity and specificity of the analysis are shown in Table 6. The best 12 markers are further shown in FIG. 8.

Tables 4-6 below summarize the performance characteristics of all markers in the following comparisons of tissues: Normal Prostate and BPH vs. Prostate Cancer (Table 4); Normal Prostate, BPH and other tissues vs. Prostate Cancer (Table 5); and Other Cancer Tissues vs. Prostate Cancer (Table 6).

The analyses in Tables 4 and 5 contained BPH and normal prostate samples in the analysis group. The analysis for Normal Prostate and BPH vs. Prostate Cancer was designed to determine the performance of the markers in a prostate specific environment. The analysis that included other tissues, both cancer and normals (Normal Prostate, BPH and Other Tissues vs. Prostate Cancer) took into consideration the performance of the markers with a background that may contribute or alter the overall performance of the markers in remote samples.

Figure 8:
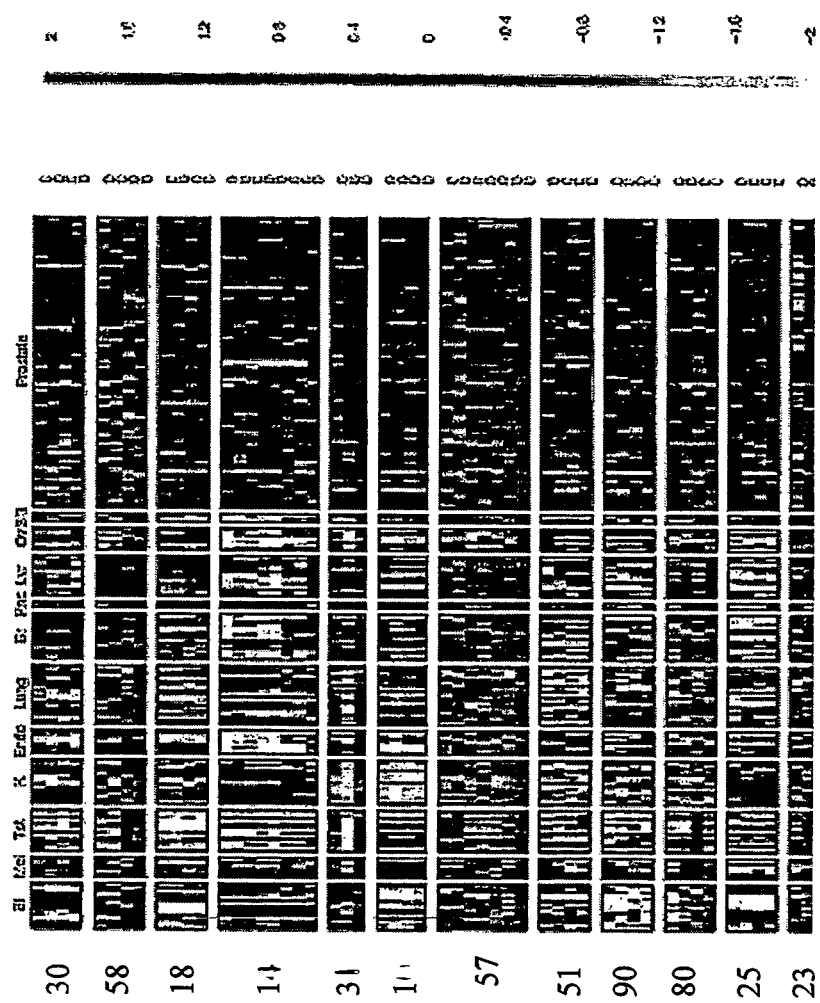
FIG. 8 shows Normal Prostate, BPH and Other Tissues vs. Prostate Cancer marker rankings according to Example 3. Each individual genomic region of interest is represented as a point. The left plot gives uncorrected p-values from the genewise logistic regression model. Lower and upper dotted lines show 5% Bonferroni and FDR limits respectively. The X-axis shows the p values for the individual CpG positions. The p values are the probabilities that the observed distribution occurred by chance in the data set. The following cancers are shown from left to right:bladder, melanoma, testes, kidney, endometrial cancer, lung, breast, pancreatic, liver, ovarian, salivary gland, and prostate.

Cancer types (Table 6) were also compared because of the propensity for GSTP1 to be methylated in multiple cancer types. This type of lack of specificity could have a negative impact on the performance of a marker in body fluid-based assays. GSTP1 (SEQ ID NO: 57) is highly methylated in prostate cancer, but also in liver cancer as anticipated. IGF2 (SEQ ID NO: 58) is similarly methylated in liver cancer. The majority of the markers shown in FIG. 8 are unmethylated in most cancer types, with the exception of prostate cancer. From FIGS. 4-8, it can be observed that there are multiple candidates that have the potential to be informative and accurate markers. It is recommended that multiple markers be combined to ensure a high sensitivity and specificity.

TABLE 4

Normal Prostate, BPH and Other Tissues vs. Prostate Cancer

| Genomic SEQ ID NO: | Treated Methylated sense strand SEQ ID NO: | Treated Methylated Antisense strand SEQ ID NO: | Treated Unmethylated SEQ ID NO: | Treated Unmethylated antisense sense strand SEQ ID NO: | P-value | Accuracy | Sensitivity | Specificity |
|---|---|---|---|---|---|---|---|---|
| 57 | 172 | 173 | 290 | 291 | 1.30E−027 | 0.86 | 0.67 | 0.93 |
| 23 | 104 | 105 | 222 | 223 | 2.00E−029 | 0.81 | 0.75 | 0.83 |
| 36 | 130 | 131 | 248 | 249 | 3.80E−018 | 0.75 | 0.75 | 0.76 |
| 56 | 170 | 171 | 288 | 289 | 1.10E−012 | 0.74 | 0.62 | 0.79 |
| 11 | 80 | 81 | 198 | 199 | 5.10E−019 | 0.74 | 0.76 | 0.74 |
| 20 | 98 | 99 | 216 | 217 | 4.90E−016 | 0.73 | 0.77 | 0.71 |
| 22 | 102 | 103 | 220 | 221 | 1.10E−009 | 0.7 | 0.61 | 0.74 |
| 31 | 120 | 121 | 238 | 239 | 6.90E−018 | 0.7 | 0.79 | 0.66 |
| 30 | 118 | 119 | 236 | 237 | 1.60E−012 | 0.69 | 0.81 | 0.64 |

TABLE 4-continued

Normal Prostate, BPH and Other Tissues vs. Prostate Cancer

| Genomic SEQ ID NO: | Treated Methylated sense strand SEQ ID NO: | Treated Methylated Antisense strand SEQ ID NO: | Treated Unmethylated SEQ ID NO: | Treated Unmethylated antisense sense strand strand SEQ ID NO: | P-value | Accuracy | Sensitivity | Specificity |
|---|---|---|---|---|---|---|---|---|
| 58 | 174 | 175 | 292 | 293 | 1.20E−011 | 0.68 | 0.71 | 0.67 |
| 34 | 126 | 127 | 244 | 245 | 5.50E−009 | 0.68 | 0.65 | 0.69 |
| 41 | 140 | 141 | 258 | 259 | 1.50E−008 | 0.67 | 0.7 | 0.66 |
| 59 | 176 | 177 | 294 | 295 | 4.90E−007 | 0.67 | 0.59 | 0.7 |
| 51 | 160 | 161 | 278 | 279 | 1.50E−012 | 0.67 | 0.76 | 0.63 |
| 24 | 106 | 107 | 224 | 225 | 1.30E−006 | 0.67 | 0.67 | 0.67 |
| 18 | 94 | 95 | 212 | 213 | 1.10E−014 | 0.67 | 0.84 | 0.6 |
| 54 | 166 | 167 | 284 | 285 | 3.80E−007 | 0.66 | 0.7 | 0.65 |
| 27 | 112 | 113 | 230 | 231 | 6.60E−007 | 0.66 | 0.7 | 0.64 |
| 7 | 72 | 73 | 190 | 191 | 8.30E−005 | 0.65 | 0.62 | 0.67 |
| 35 | 128 | 129 | 246 | 247 | 1.00E−004 | 0.65 | 0.53 | 0.69 |
| 16 | 90 | 91 | 208 | 209 | 7.50E−011 | 0.64 | 0.77 | 0.6 |
| 38 | 134 | 135 | 252 | 253 | 1.20E−004 | 0.64 | 0.63 | 0.64 |
| 14 | 86 | 87 | 204 | 205 | 5.20E−008 | 0.63 | 0.72 | 0.6 |
| 25 | 108 | 109 | 226 | 227 | 3.50E−011 | 0.62 | 0.79 | 0.56 |
| 1 | 60 | 61 | 178 | 179 | 8.20E−005 | 0.62 | 0.67 | 0.6 |
| 28 | 114 | 115 | 232 | 233 | 1.40E−003 | 0.62 | 0.67 | 0.59 |
| 43 | 144 | 145 | 262 | 263 | 3.70E−002 | 0.61 | 0.56 | 0.63 |
| 4 | 66 | 67 | 184 | 185 | 4.40E−004 | 0.61 | 0.64 | 0.59 |
| 26 | 110 | 111 | 228 | 229 | 5.60E−003 | 0.6 | 0.64 | 0.59 |
| 12 | 82 | 83 | 200 | 201 | 3.00E−004 | 0.58 | 0.75 | 0.52 |
| 21 | 100 | 101 | 218 | 219 | 1.80E−002 | 0.57 | 0.64 | 0.54 |
| 33 | 124 | 125 | 242 | 243 | 1.10E−002 | 0.56 | 0.66 | 0.53 |

TABLE 5

Normal Prostate and BPH vs. Prostate Cancer

| Genomic SEQ ID NO: | Treated methylated sense strand SEQ ID NO: | Treated methylated antisense strand SEQ ID NO: | Treated unmethylated sense strand SEQ ID NO: | Treated unmethylated antisense strand SEQ ID NO: | P-value | Accuracy | Sensitivity | Specificity |
|---|---|---|---|---|---|---|---|---|
| 57 | 172 | 173 | 290 | 291 | 4.60E−023 | 0.85 | 0.77 | 0.93 |
| 36 | 130 | 131 | 248 | 249 | 8.10E−019 | 0.81 | 0.75 | 0.86 |
| 23 | 104 | 105 | 222 | 223 | 6.10E−019 | 0.8 | 0.75 | 0.85 |
| 34 | 126 | 127 | 244 | 245 | 3.10E−015 | 0.78 | 0.71 | 0.86 |
| 20 | 98 | 99 | 216 | 217 | 1.60E−016 | 0.78 | 0.75 | 0.8 |
| 31 | 120 | 121 | 238 | 239 | 5.20E−015 | 0.76 | 0.71 | 0.81 |
| 59 | 176 | 177 | 294 | 295 | 1.90E−014 | 0.76 | 0.68 | 0.84 |
| 56 | 170 | 171 | 288 | 289 | 2.00E−013 | 0.76 | 0.65 | 0.53 |
| 30 | 118 | 119 | 236 | 237 | 5.90E−011 | 0.75 | 0.76 | 0.75 |
| 48 | 154 | 155 | 272 | 273 | 2.70E−011 | 0.74 | 0.71 | 0.78 |
| 54 | 166 | 167 | 284 | 285 | 1.20E−009 | 0.74 | 0.72 | 0.76 |
| 11 | 80 | 81 | 198 | 199 | 1.00E−010 | 0.74 | 0.69 | 0.8 |
| 24 | 106 | 107 | 224 | 225 | 1.10E−011 | 0.72 | 0.67 | 0.78 |
| 14 | 86 | 87 | 204 | 205 | 3.50E−009 | 0.71 | 0.63 | 0.8 |
| 18 | 94 | 95 | 212 | 213 | 3.10E−010 | 0.71 | 0.76 | 0.66 |
| 28 | 114 | 115 | 232 | 233 | 7.80E−008 | 0.71 | 0.69 | 0.72 |
| 8 | 74 | 75 | 192 | 193 | 4.10E−008 | 0.7 | 0.72 | 0.68 |
| 7 | 72 | 73 | 190 | 191 | 3.00E−004 | 0.7 | 0.62 | 0.78 |
| 4 | 66 | 67 | 184 | 185 | 6.30E−009 | 0.69 | 0.66 | 0.72 |
| 35 | 128 | 129 | 246 | 247 | 1.40E−008 | 0.69 | 0.59 | 0.8 |
| 27 | 112 | 113 | 230 | 231 | 1.40E−006 | 0.69 | 0.68 | 0.7 |
| 58 | 174 | 175 | 292 | 293 | 8.90E−006 | 0.68 | 0.65 | 0.71 |
| 26 | 110 | 111 | 228 | 229 | 1.20E−008 | 0.68 | 0.69 | 0.66 |
| 22 | 102 | 103 | 220 | 221 | 3.40E−008 | 0.67 | 0.57 | 0.78 |
| 41 | 140 | 141 | 258 | 259 | 7.90E−005 | 0.66 | 0.67 | 0.66 |
| 37 | 132 | 133 | 250 | 251 | 1.70E−006 | 0.66 | 0.6 | 0.73 |
| 1 | 60 | 61 | 178 | 179 | 7.40E−005 | 0.66 | 0.72 | 0.6 |
| 49 | 156 | 157 | 274 | 275 | 1.80E−005 | 0.66 | 0.62 | 0.71 |
| 16 | 90 | 91 | 208 | 209 | 1.30E−003 | 0.65 | 0.67 | 0.62 |
| 2 | 62 | 63 | 180 | 181 | 1.50E−002 | 0.64 | 0.66 | 0.63 |
| 44 | 146 | 147 | 264 | 265 | 7.50E−004 | 0.64 | 0.67 | 0.6 |
| 32 | 122 | 123 | 240 | 241 | 2.50E−003 | 0.64 | 0.59 | 0.69 |

TABLE 5-continued

Normal Prostate and BPH vs. Prostate Cancer

| Genomic SEQ ID NO: | Treated methylated sense strand SEQ ID NO: | Treated methylated antisense strand SEQ ID NO: | Treated unmethylated sense strand SEQ ID NO: | Treated unmethylated antisense strand SEQ ID NO: | P-value | Accuracy | Sensitivity | Specificity |
|---|---|---|---|---|---|---|---|---|
| 13 | 84 | 85 | 202 | 203 | 5.10E−002 | 0.63 | 0.61 | 0.66 |
| 47 | 152 | 153 | 270 | 271 | 2.00E−002 | 0.63 | 0.64 | 0.61 |
| 42 | 142 | 143 | 260 | 261 | 3.30E−003 | 0.62 | 0.67 | 0.57 |
| 55 | 168 | 169 | 286 | 287 | 7.10E−003 | 0.62 | 0.67 | 0.57 |
| 29 | 116 | 117 | 234 | 235 | 5.10E−002 | 0.62 | 0.64 | 0.59 |
| 3 | 64 | 65 | 182 | 183 | 1.30E−001 | 0.61 | 0.59 | 0.64 |
| 50 | 158 | 159 | 276 | 277 | 1.00E+000 | 0.6 | 0.64 | 0.56 |
| 51 | 160 | 161 | 278 | 279 | 2.90E−002 | 0.6 | 0.65 | 0.56 |
| 43 | 144 | 145 | 262 | 263 | 9.60E−002 | 0.6 | 0.6 | 0.61 |
| 21 | 100 | 101 | 218 | 219 | 6.20E−001 | 0.59 | 0.66 | 0.52 |
| 46 | 150 | 151 | 268 | 269 | 3.00E−001 | 0.59 | 0.59 | 0.59 |
| 10 | 78 | 79 | 196 | 197 | 5.50E−001 | 0.59 | 0.52 | 0.66 |
| 38 | 134 | 135 | 252 | 253 | 5.10E−001 | 0.58 | 0.55 | 0.62 |
| 25 | 108 | 109 | 226 | 227 | 1.20E−002 | 0.57 | 0.52 | 0.63 |
| 15 | 88 | 89 | 206 | 207 | 1.00E+000 | 0.56 | 0.48 | 0.65 |
| 6 | 70 | 71 | 188 | 189 | 1.00E+000 | 0.56 | 0.63 | 0.48 |
| 33 | 124 | 125 | 242 | 243 | 1.00E+000 | 0.55 | 0.43 | 0.68 |
| 5 | 68 | 69 | 186 | 187 | 1.00E+000 | 0.55 | 0.6 | 0.5 |
| 9 | 76 | 77 | 194 | 195 | 1.00E+000 | 0.55 | 0.53 | 0.56 |
| 52 | 162 | 163 | 280 | 281 | 1.00E+000 | 0.54 | 0.48 | 0.6 |
| 40 | 138 | 139 | 256 | 257 | 1.00E+000 | 0.53 | 0.48 | 0.58 |
| 45 | 148 | 149 | 266 | 267 | 1.00E+000 | 0.52 | 0.38 | 0.68 |
| 17 | 92 | 93 | 210 | 211 | 1.00E+000 | 0.52 | 0.58 | 0.46 |
| 12 | 82 | 83 | 200 | 201 | 1.00E+000 | 0.47 | 0.36 | 0.58 |
| 39 | 136 | 137 | 254 | 255 | 1.00E+000 | 0.45 | 0.46 | 0.45 |
| 19 | 96 | 97 | 214 | 215 | 1.00E+000 | 0.4 | 0.46 | 0.32 |

TABLE 6

Other cancers vs. Prostate cancer

| Genomic SEQ ID NO: | Treated methylated sense strand SEQ ID NO: | Treated methylated antisense strand SEQ ID NO: | Treated unmethylated sense strand SEQ ID NO: | Treated unmethylated antisense strand SEQ ID NO: | p-value | accuracy | sensitivity | specificity |
|---|---|---|---|---|---|---|---|---|
| 57 | 172 | 173 | 290 | 291 | 9.7e-14 | 0.80 | 0.70 | 0.89 |
| 23 | 104 | 105 | 222 | 223 | 2.4e-19 | 0.78 | 0.75 | 0.81 |
| 25 | 108 | 109 | 226 | 227 | 6.9e-16 | 0.75 | 0.85 | 0.65 |
| 11 | 80 | 81 | 198 | 199 | 2.0e-13 | 0.75 | 0.76 | 0.73 |
| 51 | 160 | 161 | 278 | 279 | 2.0e-12 | 0.74 | 0.79 | 0.69 |
| 31 | 120 | 121 | 238 | 239 | 1.5e-13 | 0.74 | 0.92 | 0.58 |
| 16 | 90 | 91 | 208 | 209 | 1.1e-14 | 0.73 | 0.82 | 0.66 |
| 30 | 118 | 119 | 236 | 237 | 2.4e-08 | 0.73 | 0.82 | 0.64 |
| 10 | 78 | 79 | 196 | 197 | 5.5e-11 | 0.72 | 0.83 | 0.63 |
| 41 | 140 | 141 | 258 | 259 | 9.4e-07 | 0.70 | 0.73 | 0.66 |
| 18 | 94 | 95 | 212 | 213 | 5.0e-09 | 0.69 | 0.83 | 0.57 |
| 14 | 86 | 87 | 204 | 205 | 2.8e-09 | 0.69 | 0.86 | 0.55 |
| 20 | 98 | 99 | 216 | 217 | 9.2e-07 | 0.68 | 0.78 | 0.60 |
| 12 | 82 | 83 | 200 | 201 | 9.7e-07 | 0.68 | 0.76 | 0.61 |
| 36 | 130 | 131 | 248 | 249 | 6.1e-08 | 0.67 | 0.74 | 0.62 |
| 38 | 134 | 135 | 252 | 253 | 3.8e-05 | 0.67 | 0.66 | 0.69 |
| 22 | 102 | 103 | 220 | 221 | 4.1e-05 | 0.67 | 0.62 | 0.71 |
| 58 | 174 | 175 | 292 | 293 | 1.6e-08 | 0.66 | 0.73 | 0.61 |
| 46 | 150 | 151 | 268 | 269 | 6.6e-08 | 0.66 | 0.87 | 0.48 |
| 56 | 170 | 171 | 288 | 289 | 4.6e-05 | 0.66 | 0.60 | 0.72 |
| 27 | 112 | 113 | 230 | 231 | 1.4e-02 | 0.65 | 0.69 | 0.62 |
| 21 | 100 | 101 | 218 | 219 | 5.6e-05 | 0.64 | 0.70 | 0.59 |
| 15 | 88 | 89 | 206 | 207 | 4.5e-05 | 0.63 | 0.85 | 0.43 |
| 5 | 68 | 69 | 186 | 187 | 4.4e-06 | 0.63 | 0.73 | 0.54 |
| 42 | 142 | 143 | 260 | 261 | 2.8e-04 | 0.62 | 0.77 | 0.49 |
| 34 | 126 | 127 | 244 | 245 | 6.8e-03 | 0.62 | 0.70 | 0.55 |
| 7 | 72 | 73 | 190 | 191 | 3.0e-03 | 0.62 | 0.56 | 0.66 |
| 33 | 124 | 125 | 242 | 243 | 7.6e-02 | 0.61 | 0.72 | 0.52 |
| 28 | 114 | 115 | 232 | 233 | 7.2e-01 | 0.60 | 0.73 | 0.49 |
| 6 | 70 | 71 | 188 | 189 | 2.8e-01 | 0.60 | 0.65 | 0.55 |
| 1 | 60 | 61 | 178 | 179 | 9.5e-02 | 0.59 | 0.60 | 0.58 |

TABLE 6-continued

Other cancers vs. Prostate cancer

| Genomic SEQ ID NO: | Treated methylated sense strand SEQ ID NO: | Treated methylated antisense strand SEQ ID NO: | Treated unmethylated sense strand SEQ ID NO: | Treated unmethylated antisense strand SEQ ID NO: | p-value | accuracy | sensitivity | specificity |
|---|---|---|---|---|---|---|---|---|
| 59 | 176 | 177 | 294 | 295 | 5.1e−02 | 0.59 | 0.62 | 0.56 |
| 43 | 144 | 145 | 262 | 263 | 4.2e−01 | 0.59 | 0.58 | 0.60 |
| 24 | 106 | 107 | 224 | 225 | 1.3e−01 | 0.59 | 0.76 | 0.43 |
| 37 | 132 | 133 | 250 | 251 | 1.1e−01 | 0.59 | 0.69 | 0.49 |
| 48 | 154 | 155 | 272 | 273 | 5.8e−01 | 0.59 | 0.72 | 0.47 |
| 4 | 66 | 67 | 184 | 185 | 4.2e−02 | 0.58 | 0.71 | 0.48 |
| 45 | 148 | 149 | 266 | 267 | 1.0e+00 | 0.58 | 0.79 | 0.40 |
| 39 | 136 | 137 | 254 | 255 | 3.1e−02 | 0.58 | 0.55 | 0.61 |
| 55 | 168 | 169 | 286 | 287 | 1.0e+00 | 0.58 | 0.69 | 0.48 |
| 26 | 110 | 111 | 228 | 229 | 7.3e−02 | 0.58 | 0.67 | 0.49 |
| 2 | 62 | 63 | 180 | 181 | 1.0e+00 | 0.57 | 0.63 | 0.52 |
| 54 | 166 | 167 | 284 | 285 | 8.2e−01 | 0.57 | 0.68 | 0.47 |
| 49 | 156 | 157 | 274 | 275 | 5.9e−02 | 0.56 | 0.82 | 0.34 |
| 8 | 74 | 75 | 192 | 193 | 1.0e+00 | 0.56 | 0.61 | 0.51 |
| 13 | 84 | 85 | 202 | 203 | 1.0e+00 | 0.56 | 0.59 | 0.53 |
| 32 | 122 | 123 | 240 | 241 | 1.0e+00 | 0.55 | 0.63 | 0.49 |
| 29 | 116 | 117 | 234 | 235 | 1.0e+00 | 0.55 | 0.55 | 0.55 |
| 19 | 96 | 97 | 214 | 215 | 1.0e+00 | 0.55 | 0.54 | 0.55 |
| 47 | 152 | 153 | 270 | 271 | 1.0e+00 | 0.54 | 0.84 | 0.29 |
| 9 | 76 | 77 | 194 | 195 | 9.7e−02 | 0.54 | 0.55 | 0.53 |
| 50 | 158 | 159 | 276 | 277 | 1.0e+00 | 0.54 | 0.62 | 0.47 |
| 52 | 162 | 163 | 280 | 281 | 1.0e+00 | 0.54 | 0.51 | 0.56 |
| 17 | 92 | 93 | 210 | 211 | 1.0e+00 | 0.54 | 0.49 | 0.57 |
| 44 | 146 | 147 | 264 | 265 | 1.0e+00 | 0.53 | 0.60 | 0.47 |
| 35 | 128 | 129 | 246 | 247 | 1.0e+00 | 0.52 | 0.45 | 0.59 |
| 3 | 64 | 65 | 182 | 183 | 1.0e+00 | 0.52 | 0.59 | 0.45 |
| 40 | 138 | 139 | 256 | 257 | 1.0e+00 | 0.51 | 0.56 | 0.47 |

TABLE 7 is to be found at the beginning of Example 3.

TABLE 8

| Name and/or SEQ ID No: | Primer: | Amplificate Length: |
|---|---|---|
| (SEQ ID NO: 1) | TGGTATAGGAGGAGAAGAGTTG (SEQ ID NO: 296) TCAATCCCTAAAACCCAAA (SEQ ID NO: 297) | 327 |
| (SEQ ID NO: 2) | ACCCAAACTAACAATCAAAAAT (SEQ ID NO: 299) GGAAGGGAAGGATGAGAGTAT (SEQ ID NO: 298) | 326 |
| (SEQ ID NO: 3) | GGAAGGTTTAAGGTGAGAGAA (SEQ ID NO: 300) CAAAATAACCAATCCCCTAAA (SEQ ID NO: 301) | 339 |
| LIM/HOMEOBOX PROTEIN LHX9 (SEQ ID NO: 4) | CCCCAATATAAATCTACCAACC (SEQ ID NO: 303) TTATTTGAATTTTGGAGGTTATG (SEQ ID NO: 302) | 372 |
| (SEQ ID NO: 5) | TTAATGAAGTAGGGTTTGTATTGT (SEQ ID NO: 304) CCTCCAAAATCTTAACCAAAT (SEQ ID NO: 305) | 421 |
| (SEQ ID NO: 6) | CCCAACTAACTCAAATTCCAC (SEQ ID NO: 307) TTTATTTTAGGAGGGAAGGATT (SEQ ID NO: 306) | 434 |
| (SEQ ID NO: 7) | GTGGTTTTGGGGAATTAGTAT (SEQ ID NO: 308) CTCCTACATATCCCATCTCATC (SEQ ID NO: 309) | 483 |
| UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN) (SEQ ID NO: 8) | AATTAAGGTTTAGGGTTTTGTTT (SEQ ID NO: 310) ACCTTCCCTACAAATCTACCTAC (SEQ ID NO: 311) | 365 |
| BASSOON; ZINC FINGER PROTEIN 231; NEURONAL DOUBLE ZINC FINGER PROTEIN (SEQ ID NO: 9) | ATAGTTTTGTGGGTTTAAGAGG (SEQ ID NO: 312) ACCCTAACCTTATACAATACCAAC (SEQ ID NO: 313) | 414 |
| BASSOON; ZINC FINGER PROTEIN 231; NEURONAL DOUBLE ZINC FINGER PROTEIN (SEQ ID NO: 9) | GGTGGGGTTATTAAGGAGTTTA (SEQ ID NO: 314) CTCAACTACCATACCCAAAAA (SEQ ID NO: 315) | 480 |

TABLE 8-continued

| Name and/or SEQ ID No: | Primer: | Amplificate Length: |
|---|---|---|
| (SEQ ID NO: 10) | TTGTGTTGGTTGTAAAAGGA (SEQ ID NO: 316) CAAACACTATACACCTCTCAACA (SEQ ID NO: 317) | 428 |
| (SEQ ID NO: 11) | TTGAGGTTATTGGTTTATAGATTTT (SEQ ID NO: 318) CCCTAACCACCCCTTCTA (SEQ ID NO: 319) | 457 |
| (SEQ ID NO: 12) | ACTCCATACACTTTTACCAACC (SEQ ID NO: 321) TGTGTGAAATGTTTTAGTTTAATTG (SEQ ID NO: 320) | 455 |
| HOOK2 PROTEIN (SEQ ID NO: 13) | TGTGTTAGGAATGATTGGGTA (SEQ ID NO: 322) AATTTCAAAACCAAAATCACC (SEQ ID NO: 323) | 461 |
| (SEQ ID NO: 14) | AATTACCAAACCAATTCCTCTTA (SEQ ID NO: 325) GGTTGGGATTTTAGTGTGTG (SEQ ID NO: 324) | 366 |
| (SEQ ID NO: 14) | TTATTTGAGGGATTTATTGGAG (SEQ ID NO: 326) CCTTATTAAAACTTACCACCCTAT (SEQ ID NO: 327) | 382 |
| (SEQ ID NO: 15) | GTGGGTTAGTGGGAGGTTAT (SEQ ID NO: 328) TAAAAACCCTTCCTACCTCTTA (SEQ ID NO: 329) | 440 |
| (SEQ ID NO: 16) | AGATGGGTATGTATTTTGGGTT (SEQ ID NO: 330) ACTAAACTCAACCACCTCACTAA (SEQ ID NO: 331) | 181 |
| (SEQ ID NO: 17) | TTTTGGTTAGTTTTATGGGGTA (SEQ ID NO: 332) CACTACTTCAAATCCATCATCA (SEQ ID NO: 333) | 484 |
| LYSOSOMAL-ASSOCIATED MULTITRANSMEMBRANE PROTEIN (RETINOIC ACID-INDUCIBLE E3 PROTEIN) (HA1520) LAM5 (SEQ ID NO: 18) | TAACTTCACAAATTACCCAACA (SEQ ID NO: 335) AAGAGTGAGGAGTAAGGGAGTT (SEQ ID NO: 334) | 455 |
| "TYPE I INOSITOL-1,4,5-TRISPHOSPHATE 5-PHOSPHATASE (EC 3.1.3.56) (5PTASE) (SEQ ID NO: 19) | TTTTGGGGTTAGTATGTGAGTT (SEQ ID NO: 336) ATCCCAACAACTTCTTCCTC (SEQ ID NO: 337) | 482 |
| PROSTAGLANDIN E2 RECEPTOR, EP4 SUBTYPE (PROSTANOID EP4 RECEPTOR) (PGE RECEPTOR, EP4 SUBTYPE) (SEQ ID NO: 20) | GAAGAGGAATGGGAAAATTAG (SEQ ID NO: 338) TCACCAACAAAATACCCAA (SEQ ID NO: 339) | 500 |
| PROSTAGLANDIN E2 RECEPTOR, EP4 SUBTYPE (PROSTANOID EP4 RECEPTOR) (PGE RECEPTOR, EP4 SUBTYPE) (SEQ ID NO: 20) | AACCATCAACCATACCTATTTC (SEQ ID NO: 341) TGAGTAAGATGATTATTTGGATTT (SEQ ID NO: 340) | 467 |
| (SEQ ID NO: 21) | CACTTCCCACCTCCTTATATC (SEQ ID NO: 343) ATTGGGTTTGAAAGAGTTGTAG (SEQ ID NO: 342) | 398 |
| (SEQ ID NO: 22) | ATGATGGAATATGTAAGAATGA (SEQ ID NO: 344) CTTCTCACTACTAATCTCCTACCC (SEQ ID NO: 345) | 290 |
| EQUILIBRATIVE NUCLEOSIDE TRANSPORTER 1 (EQUILIBRATIVE NITROBENZYL-MERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE (SEQ ID NO: 23) | GAGTTGGAGGGTTTTGTTTTA (SEQ ID NO: 346) CAAACTCCCATAAAATTCATCT (SEQ ID NO: 347) | 410 |
| ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR) (SEQ ID NO: 24) | CCACTCACTCAACCCATAA (SEQ ID NO: 349) GTGTGAGGGTTTGGGTATTTTT (SEQ ID NO: 348) | 398 |
| PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN) (SEQ ID NO: 25) | GATGGTGGGTAGTGTTGTTTAT (SEQ ID NO: 350) AAAACCTATCTACACCTTTCTCTT (SEQ ID NO: 351) | 378 |
| (SEQ ID NO: 26) | ATTCCCACCAAAACCTCTAC (SEQ ID NO: 353) AATTAGAGAAGGTTAAATGGGTT (SEQ ID NO: 352) | 300 |

TABLE 8-continued

| Name and/or SEQ ID No: | Primer: | Amplificate Length: |
|---|---|---|
| (SEQ ID NO: 27) | AATAACTCCAACTTTCCTCCC (SEQ ID NO: 355) GGGATTTGGGAATTTATTGT (SEQ ID NO: 354) | 237 |
| (SEQ ID NO: 27) | GGTGGATGAGTAGTTTGAAGTTT (SEQ ID NO: 356) AAAAACCCCTTTCCCTCT (SEQ ID NO: 357) | 427 |
| (SEQ ID NO: 28) | GTTGGGGTTTAGTAATTGAAAA (SEQ ID NO: 358) ACCAACACAAACTAACACTTACAT (SEQ ID NO: 359) | 404 |
| PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | AAGAGGTTTTATGGTGTTTGAG (SEQ ID NO: 360) CACTCCCTTCCCAAACTATAC (SEQ ID NO: 361) | 473 |
| HOMEOBOX PROTEIN HOX-B6 (HOX-2B) (HOX-2.2) (SEQ ID NO: 30) | CTCCTCAATTCTCACCAAAA (SEQ ID NO: 363) GTGGAAAAAGGAGAGTAAATTG (SEQ ID NO: 362) | 356 |
| LIM DOMAIN KINASE 1 (EC 2.7.1.37) (LIMK-1) (SEQ ID NO: 31) | AAACCCTACTTCCTACAAACAA (SEQ ID NO: 365) AGGGAGGTTTGGTGTATTTT (SEQ ID NO: 364) | 420 |
| LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32) (SEQ ID NO: 32) | CAATCCCCTTAAAACAAACC (SEQ ID NO: 367) GGAAAGGATAGGATGTTGGAT (SEQ ID NO: 366) | 500 |
| 1-ACYL-SN-GLYCEROL-3-PHOSPHATE ACYLTRANSFERASE GAMMA (EC 2.3.1.51) (1-AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O-ACYLTRANSFERASE 3) (SEQ ID NO: 33) | CACAATTTCCCACAAAACA (SEQ ID NO: 369) TTAGGGAGATGAGATTAAAGGA (SEQ ID NO: 368) | 379 |
| HOMEOBOX PROTEIN GSH-2 (SEQ ID NO: 34) | TATATGGGGTGGGAGTATTTT (SEQ ID NO: 370) CCTTCCCCTCCTTCTTATACT (SEQ ID NO: 371) | 276 |
| (SEQ ID NO: 35) | AAAATTCTTTCCTCTCCTAAACA (SEQ ID NO: 373) TTAGGGGTTATTAGGTTAAATGA (SEQ ID NO: 372) | 478 |
| HISTONE H4 (SEQ ID NO: 36) | TTAGTTGAGAAAGTGGGGGT (SEQ ID NO: 374) CTACCTCAAACCAAAATCCTC (SEQ ID NO: 375) | 421 |
| POTASSIUM VOLTAGE-GATED CHANNEL SUBFAMILY KQT MEMBER 2 (NEUROBLASTOMA-SPECIFIC POTASSIUM CHANNEL KQT-LIKE 2) (SEQ ID NO: 37) | TTTTGGAGTTATAGGGTTTTGT (SEQ ID NO: 376) CTTCAACATCTCCCAATCC (SEQ ID NO: 377) | 441 |
| ADAPTER-RELATED PROTEIN COMPLEX 1 SIGMA 1B SUBUNIT (SIGMA-ADAPTIN 1B) (ADAPTOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA 1B SMALL CHAIN) (SIGMA 1B SUBUNIT OF AP-1 CLATHRIN) (DC22) (SEQ ID NO: 38) | AAACCTAAAAATCCAACACAAA (SEQ ID NO: 379) GGGTTATGTTAAGGGAGAAAG (SEQ ID NO: 378) | 215 |
| (SEQ ID NO: 39) | AATAACCTAATCTCCAAACCC (SEQ ID NO: 381) ATTTGTGGTAGTTAATAGGTATGTTTA (SEQ ID NO: 380) | 465 |
| (SEQ ID NO: 40) | TACCCACCATATACCAAAACTAAA (SEQ ID NO: 383) TAGAGAAGTTGTTGTTGGTTG (SEQ ID NO: 382) | 484 |
| PERIPLAKIN (195 KDA CORNIFIED ENVELOPE PRECURSOR) (190 KDA PARANEOPLASTIC PEMPHIGUS ANTIGEN) (SEQ ID NO: 41) | ATTTGAGGGGTATTATTTGTTG (SEQ ID NO: 384) AACCACCTTCTCCCCTAAT (SEQ ID NO: 385) | 409 |
| (SEQ ID NO: 42) | GTAATAATTGGGTTAGGGGTTA (SEQ ID NO: 386) AACCAATATCAAATAACTAAAATCC (SEQ ID NO: 387) | 394 |

TABLE 8-continued

| Name and/or SEQ ID No: | Primer: | Amplificate Length: |
|---|---|---|
| (SEQ ID NO: 43) | AAAATCCAATCCTAAAACCCTA (SEQ ID NO: 389) TATTTGAGAAAGTGGTAGGAGG (SEQ ID NO: 388) | 296 |
| (SEQ ID NO: 44) | AACCCTAACTTCTAAACAATTCC (SEQ ID NO: 391) TTTATGTTTGTTGGGGGTAGT (SEQ ID NO: 390) | 492 |
| (SEQ ID NO: 45) | ACCCCAATCAACTACATAACTAA (SEQ ID NO: 393) GTGAGAGTGGGTGTTGAAAT (SEQ ID NO: 392) | 498 |
| (SEQ ID NO: 46) | GAAGGTAGGTTAGTAAGAAGGGT (SEQ ID NO: 394) TACCTAATCCCCCAAAACA (SEQ ID NO: 395) | 289 |
| (SEQ ID NO: 47) | CACTCACTTAATCATCACCATC (SEQ ID NO: 397) GGAGGAGTTGGGAGTTAGTAT (SEQ ID NO: 396) | 459 |
| (SEQ ID NO: 48) | TGATTTGATTAGTTTGGTATTGTT (SEQ ID NO: 398) CAAACACCCCTTAACCCT (SEQ ID NO: 399) | 454 |
| (SEQ ID NO: 49) | TAGTGTGTTTGGTTAGAGTGGT (SEQ ID NO: 400) ACACATCTTAAACTTCCCCA (SEQ ID NO: 401) | 249 |
| DNA REPLICATION FACTOR; DOUBLE PARKED, DROSOPHILA, HOMOLOG OF (SEQ ID NO: 50) | AACCAACACCTCCTAAACAAT (SEQ ID NO: 403) GTTGGGTTTATTTTGAGTTGAG (SEQ ID NO: 402) | 412 |
| PR-DOMAIN ZINC FINGER PROTEIN 16 (TRANSCRIPTION FACTOR MEL1) (SEQ ID NO: 51) | TTGTTTGTTTTGAGTAAGAAGG (SEQ ID NO: 404) ATACCCCAATAACCACCTCTAT (SEQ ID NO: 405) | 475 |
| TUMOR SUPPRESSING SUBTRANSFERABLE CANDIDATE 5; P45 BECK-WITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLY-SPECIFIC TRANSPORTER-RELATED PRO- | ACCAATCTAAAAATCCCCAAC (SEQ ID NO: 407) GGTATTAGGAGGTAGAAGTGGA (SEQ ID NO: 406) | 474 |

TABLE 8-continued

| Name and/or SEQ ID No: | Primer: | Amplificate Length: |
|---|---|---|
| TEIN (SEQ ID NO: 52) | | |
| CDH1 (SEQ ID NO: 54) | GAGGTTGGGGTTAGAGGAT (SEQ ID NO: 408) CAAACTCACAAATACTTTACAATTC (SEQ ID NO: 409) | 478 |
| CD44 (SEQ ID NO: 56) | GAAAGGAGAGGTTAAAGGTTG (SEQ ID NO: 410) AACTCACTTAACTCCAATCCC (SEQ ID NO: 411) | 696 |
| GSTP1 (SEQ ID NO: 57) | CCTCTCCCCTACCCTATAAA (SEQ ID NO: 413) GTTGGTTTTATGTTGGGAGTT (SEQ ID NO: 412) | 469 |
| VIAAT (SEQ ID NO: 59) | CAAACCCAATTCTCAATATCC (SEQ ID NO: 415) GAAGTTGTTGTATATGAGGTTGTTA (SEQ ID NO: 414) | 434 |

TABLE 9

| Gene name and/or No: SEQ ID NO | Oligo: |
|---|---|
| 1 VIAAT (SEQ ID NO: 59) | TAGACGCGGACGTTTA (SEQ ID NO: 416) |
| 2 VIAAT (SEQ ID NO: 59) | TAATTAGATGTGGATGTT (SEQ ID NO: 417) |
| 3 VIAAT (SEQ ID NO: 59) | TTCGTATAGGTACGCGA (SEQ ID NO: 418) |
| 4 VIAAT (SEQ ID NO: 59) | TTTTGTATAGGTATGTGA (SEQ ID NO: 419) |
| 5 VIAAT (SEQ ID NO: 59) | TTCGTACGCGTATTAT (SEQ ID NO: 420) |
| 6 VIAAT (SEQ ID NO: 59) | GAGTTTTGTATGTGTATT (SEQ ID NO: 421) |
| 7 VIAAT (SEQ ID NO: 59) | TTCGGTCGTTTAGCGT (SEQ ID NO: 422) |
| 8 VIAAT (SEQ ID NO: 59) | ATTTGGTTGTTTAGTGT (SEQ ID NO: 423) |
| 9 (SEQ ID NO: 1) | GTCGGTGGTTCGAGTA (SEQ ID NO: 424) |
| 10 (SEQ ID NO: 1) | GTTGGTGGTTTGAGTAT (SEQ ID NO: 425) |
| 11 (SEQ ID NO: 1) | GGAATTCGACGGGGAG (SEQ ID NO: 426) |
| 12 (SEQ ID NO: 1) | GGGAATTTGATGGGGA (SEQ ID NO: 427) |
| 13 (SEQ ID NO: 1) | TTCGTCGGGCGTTTAG (SEQ ID NO: 428) |
| 14 (SEQ ID NO: 1) | TTTGTTGGGTGTTTAGT (SEQ ID NO: 429) |
| 15 (SEQ ID NO: 1) | GTCGTTCGTCGATGTA (SEQ ID NO: 430) |

TABLE 9-continued

| No: SEQ ID NO | Gene name and/or Oligo: |
|---|---|
| 16 (SEQ ID NO: 1) | GGTTGTTTGTTGATGTAG (SEQ ID NO: 431) |
| 17 (SEQ ID NO: 2) | GTATTGCGCGTTTATT (SEQ ID NO: 432) |
| 18 (SEQ ID NO: 2) | AGGGTATTGTGTGTTTA (SEQ ID NO: 433) |
| 19 (SEQ ID NO: 2) | AGGTACGTGGCGTTTT (SEQ ID NO: 434) |
| 20 (SEQ ID NO: 2) | AGGTATGTGGTGTTTT (SEQ ID NO: 435) |
| 21 (SEQ ID NO: 2) | GAGTTGCGCGGTAGTT (SEQ ID NO: 436) |
| 22 (SEQ ID NO: 2) | AGGAGTTGTGTGGTAG (SEQ ID NO: 437) |
| 23 (SEQ ID NO: 2) | ATAGTTTTCGCGTTTT (SEQ ID NO: 438) |
| 24 (SEQ ID NO: 2) | AGTTTTTGTGTTTTAGGA (SEQ ID NO: 439) |
| 25 (SEQ ID NO: 3) | TTTCGGTCGCGAATAT (SEQ ID NO: 440) |
| 26 (SEQ ID NO: 3) | TTTGGTTGTGAATATTTT (SEQ ID NO: 441) |
| 27 (SEQ ID NO: 3) | GTCGAGAGTTCGCGTT (SEQ ID NO: 442) |
| 28 (SEQ ID NO: 3) | TAGTTGAGAGTTTGTGT (SEQ ID NO: 443) |
| 29 (SEQ ID NO: 3) | TTTCGGTACGACGTTT (SEQ ID NO: 444) |
| 30 (SEQ ID NO: 3) | GAGTTTTGGTATGATGT (SEQ ID NO: 445) |
| 31 (SEQ ID NO: 3) | ATTGGGCGCGGTTTAA (SEQ ID NO: 446) |
| 32 (SEQ ID NO: 3) | ATTGGGTGTGGTTTAA (SEQ ID NO: 447) |
| 33 LIM/HOMEOBOX PROTEIN LHX9 (SEQ ID NO: 4) | ATTGTCGGGATACGTT (SEQ ID NO: 448) |
| 34 LIM/HOMEOBOX PROTEIN LHX9 (SEQ ID NO: 4) | GATTGTTGGGATATGTT (SEQ ID NO: 449) |
| 35 LIM/HOMEOBOX PROTEIN LHX9 (SEQ ID NO: 4) | TTAGTGTCGCGTTATT (SEQ ID NO: 450) |
| 36 LIM/HOMEOBOX PROTEIN LHX9 (SEQ ID NO: 4) | AGTGTTGTGTTATTTGG (SEQ ID NO: 451) |
| 37 LIM/HOMEOBOX PROTEIN LHX9 (SEQ ID NO: 4) | TGAAACGTTAGCGTTA (SEQ ID NO: 452) |
| 38 LIM/HOMEOBOX PROTEIN LHX9 (SEQ ID NO: 4) | AGTGAAATGTTAGTGTT (SEQ ID NO: 453) |
| 39 LIM/HOMEoBOX PROTEIN LHX9 (SEQ ID NO: 4) | AAAGGCGCGGTTTTA (SEQ ID NO: 454) |
| 40 LIM/HOMEOBOX PROTEIN LHX9 (SEQ ID NO: 4) | TTGAAAGGTGTGGTTT (SEQ ID NO: 455) |
| 41 (SEQ ID NO: 5) | TAAGTAGCGGCGTTGT (SEQ ID NO: 456) |
| 42 (SEQ ID NO: 5) | TAAGTAGTGGTGTTGTA (SEQ ID NO: 457) |
| 43 (SEQ ID NO: 5) | GAGATGAGCGTCGTGG (SEQ ID NO: 458) |
| 44 (SEQ ID NO: 5) | GAGATGAGTGTTGTGG (SEQ ID NO: 459) |
| 45 (SEQ ID NO: 5) | GTCGTTCGTTAGTAACGG (SEQ ID NO: 460) |
| 46 (SEQ ID NO: 5) | GTTGTTTGTTAGTAATGG (SEQ ID NO: 461) |
| 47 (SEQ ID NO: 5) | TATCGGTTTTCGCGGT (SEQ ID NO: 462) |
| 48 (SEQ ID NO: 5) | ATATTGGTTTTGTGGT (SEQ ID NO: 463) |
| 49 (SEQ ID NO: 5) | TTGGACGGCGTGTATT (SEQ ID NO: 464) |
| 50 (SEQ ID NO: 5) | TTTGGATGGTGTGTAT (SEQ ID NO: 465) |
| 51 (SEQ ID NO: 6) | GACGTTGTCGTAATGA (SEQ ID NO: 466) |
| 52 (SEQ ID NO: 6) | TGATGTTGTTGTAATGA (SEQ ID NO: 467) |
| 53 (SEQ ID NO: 6) | AGTATACGAGACGCGA (SEQ ID NO: 468) |
| 54 (SEQ ID NO: 6) | AGAGTATATGAGATGTGA (SEQ ID NO: 469) |
| 55 (SEQ ID NO: 6) | TTCGTTTATCGTGCGG (SEQ ID NO: 470) |
| 56 (SEQ ID NO: 6) | TTTGTTTATTGTGTGGT (SEQ ID NO: 471) |
| 57 (SEQ ID NO: 6) | AGGACGTAGAGCGTAG (SEQ ID NO: 472) |
| 58 (SEQ ID NO: 6) | TGAGGATGTAGAGTGT (SEQ ID NO: 473) |
| 59 (SEQ ID NO: 7) | TATAGACGGTGGGCGA (SEQ ID NO: 474) |
| 60 (SEQ ID NO: 7) | TATAGATGGTGGGTGA (SEQ ID NO: 475) |
| 61 (SEQ ID NO: 7) | ATTTATCGCGGTGGTT (SEQ ID NO: 476) |
| 62 (SEQ ID NO: 7) | GGATTTATTGTGGTGG (SEQ ID NO: 477) |
| 63 (SEQ ID NO: 7) | ATTCGTTGATTCGCGG (SEQ ID NO: 478) |
| 64 (SEQ ID NO: 7) | TTTGTTGATTTGTGGG (SEQ ID NO: 479) |
| 65 UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) | TTTAGTCGATTCGGGA (SEQ ID NO: 480) |

TABLE 9-continued

| No: | Gene name and/or SEQ ID NO | Oligo: |
|---|---|---|
| | (GMP1) (SENTRIN) (SEQ ID NO: 8) | |
| 66 | UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN) (SEQ ID NO: 8) | AGTTGATTTGGGAGAA (SEQ ID NO: 481) |
| 67 | UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN) (SEQ ID NO: 8) | TGAGCGAGTTCGGAGA (SEQ ID NO: 482) |
| 68 | UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN) (SEQ ID NO: 8) | GATGAGTGAGTTTGGA (SEQ ID NO: 483) |
| 69 | UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN) (SEQ ID NO: 8) | TTTCGGGAGTTTCGTA (SEQ ID NO: 484) |
| 70 | UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN) (SEQ ID NO: 8) | TTTGGGAGTTTTGTAGT (SEQ ID NO: 485) |
| 71 | UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN) (SEQ ID NO: 8) | TTTCGGTCGTAGTCGG (SEQ ID NO: 486) |
| 72 | UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN) (SEQ ID NO: 8) | ATTTTTGGTTGTAGTTGG (SEQ ID NO: 487) |
| 73 | BASSOON; ZINC FINGER PROTEIN 231; NEURONAL DOUBLE ZINC FINGER PROTEIN (SEQ ID NO: 9) | ATTGAGTTCGGGTTCGT (SEQ ID NO: 488) |
| 74 | BASSOON; ZINC FINGER PROTEIN 231; NEURONAL DOUBLE ZINC FINGER PROTEIN (SEQ ID NO: 9) | ATTGAGTTTGGGTTTGT (SEQ ID NO: 489) |
| 75 | BASSOON; ZINC FINGER PROTEIN 231; NEURONAL DOUBLE ZINC FINGER PROTEIN (SEQ ID NO: 9) | TAGCGTATATGCGATT (SEQ ID NO: 490) |
| 76 | BASSOON; ZINC FINGER PROTEIN 231; NEURONAL DOUBLE ZINC FINGER PROTEIN (SEQ ID NO: 9) | GGGTAGTGTATATGTGA (SEQ ID NO: 491) |
| 77 | BASSOON; ZINC FINGER PROTEIN 231; NEURONAL DOUBLE ZINC FINGER PROTEIN (SEQ ID NO: 9) | ATATGCGATTGATTTACGG (SEQ ID NO: 492) |
| 78 | BASSOON; ZINC FINGER PROTEIN 231; NEURONAL DOUBLE ZINC FINGER PROTEIN (SEQ ID NO: 9) | ATATGTGATTGATTTATGG (SEQ ID NO: 493) |
| 79 | BASSOON; ZINC FINGER PROTEIN 231; NEURONAL DOUBLE ZINC FINGER PROTEIN (SEQ ID NO: 9) | TTATAGCGTCGTATGG (SEQ ID NO: 494) |
| 80 | BASSOON; ZINC FINGER PROTEIN 231; NEURONAL DOUBLE ZINC FINGER PROTEIN (SEQ ID NO: 9) | ATAGTGTTGTATGGGAA (SEQ ID NO: 495) |
| 81 | BASSOON; ZINC FINGER PROTEIN 231; NEURONAL DOUBLE ZINC FINGER PROTEIN (SEQ ID NO: 9) | GACGTAGGTTCGTGAT (SEQ ID NO: 496) |
| 82 | BASSOON; ZINC FINGER PROTEIN 231; NEURONAL DOUBLE ZINC FINGER PROTEIN (SEQ ID NO: 9) | ATGATGTAGGTTTGTGA (SEQ ID NO: 497) |
| 83 | BASSOON; ZINC FINGER PROTEIN 231; NEURONAL DOUBLE ZINC FINGER PROTEIN (SEQ ID NO: 9) | GGTAGCGTTTATTCGT (SEQ ID NO: 498) |
| 84 | BASSOON; ZINC FINGER PROTEIN 231; NEURONAL DOUBLE ZINC FINGER PROTEIN (SEQ ID NO: 9) | AGGTAGTGTTTATTTGTA (SEQ ID NO: 499) |
| 85 | BASSOON; ZINC FINGER PROTEIN 231; NEURONAL DOUBLE ZINC FINGER PROTEIN (SEQ ID NO: 9) | ATAGTCGAGTTTCGTT (SEQ ID NO: 500) |
| 86 | BASSOON; ZINC FINGER PROTEIN 231; NEURONAL DOUBLE ZINC FINGER PROTEIN (SEQ ID NO: 9) | GTTGAGTTTTGTTTAGG (SEQ ID NO: 501) |
| 87 | BASSOON; ZINC FINGER PROTEIN 231; NEURONAL DOUBLE ZINC FINGER PROTEIN (SEQ ID NO: 9) | TGGGTATACGTGTTAG (SEQ ID NO: 502) |
| 88 | BASSOON; ZINC FINGER PROTEIN 231; NEURONAL DOUBLE ZINC FINGER PROTEIN (SEQ ID NO: 9) | TATGGGTATATGTGTTAG (SEQ ID NO: 503) |

TABLE 9-continued

| No: SEQ ID NO | Gene name and/or Oligo: |
|---|---|
| 89 BASSOON; ZINC FINGER PROTEIN 231; NEURONAL DOUBLE ZINC FINGER PROTEIN (SEQ ID NO: 9) | TTAGATGCGTAAGGTT (SEQ ID NO: 504) |
| 90 BASSOON; ZINC FINGER PROTEIN 231; NEURONAL DOUBLE ZINC FINGER PROTEIN (SEQ ID NO: 9) | ATTAGATGTGTAAGGTTT (SEQ ID NO: 505) |
| 91 BASSOON; ZINC FINGER PROTEIN 231; NEURONAL DOUBLE ZINC FINGER PROTEIN (SEQ ID NO: 9) | TTATGGGTCGTAGGAT (SEQ ID NO: 506) |
| 92 BASSOON; ZINC FINGER PROTEIN 231; NEURONAL DOUBLE ZINC FINGER PROTEIN (SEQ ID NO: 9) | ATGGGTTGTAGGATTG (SEQ ID NO: 507) |
| 93 (SEQ ID NO: 10) | TTCGTTTAGTTACGTACGG (SEQ ID NO: 508) |
| 94 (SEQ ID NO: 10) | TTTGTTTAGTTATGTATGG (SEQ ID NO: 509) |
| 95 (SEQ ID NO: 10) | TAGTTACGTACGGATAT (SEQ ID NO: 510) |
| 96 (SEQ ID NO: 10) | TTATGTATGGATATTTTGG (SEQ ID NO: 511) |
| 97 (SEQ ID NO: 10) | AGGATACGTAGTTCGT (SEQ ID NO: 512) |
| 98 (SEQ ID NO: 10) | AGGATATGTAGTTTGTATA (SEQ ID NO: 513) |
| 99 (SEQ ID NO: 10) | AGTTCGTATATTTTCGG (SEQ ID NO: 514) |
| 100 (SEQ ID NO: 10) | AGTTTGTATATTTTTGGTA (SEQ ID NO: 515) |
| 101 (SEQ ID NO: 11) | TACGGGGTCGTTCGTA (SEQ ID NO: 516) |
| 102 (SEQ ID NO: 11) | TATGGGGTTGTTTGTAT (SEQ ID NO: 517) |
| 103 (SEQ ID NO: 11) | TTCGTAGGCGATCGTA (SEQ ID NO: 518) |
| 104 (SEQ ID NO: 11) | GATTTGTAGGTGATTGT (SEQ ID NO: 519) |
| 105 (SEQ ID NO: 11) | TAGCGGTCGATTCGTT (SEQ ID NO: 520) |
| 106 (SEQ ID NO: 11) | TAGTGGTTGATTTGTTT (SEQ ID NO: 521) |
| 107 (SEQ ID NO: 11) | GTCGTTACGTTTTTCGG (SEQ ID NO: 522) |
| 108 (SEQ ID NO: 11) | TAGAGTTGTTATGTTTTTTGG (SEQ ID NO: 523) |
| 109 (SEQ ID NO: 12) | AAGTTCGTTACGGCGG (SEQ ID NO: 524) |
| 110 (SEQ ID NO: 12) | AGTTTGTTATGGTGGG (SEQ ID NO: 525) |
| 111 (SEQ ID NO: 12) | TACGTTGGTCGACGTT (SEQ ID NO: 526) |
| 112 (SEQ ID NO: 12) | TTTATGTTGGTTGATGT (SEQ ID NO: 527) |
| 113 (SEQ ID NO: 12) | GAGTCGGACGGTGTTT (SEQ ID NO: 528) |
| 114 (SEQ ID NO: 12) | GAGTTGGATGGTGTTT (SEQ ID NO: 529) |
| 115 HOOK2 PROTEIN (SEQ ID NO: 13) | TAGCGTAAAGGGACGAG (SEQ ID NO: 530) |
| 116 HOOK2 PROTEIN (SEQ ID NO: 13) | TAGTGTAAAGGGATGAG (SEQ ID NO: 531) |
| 117 HOOK2 PROTEIN (SEQ ID NO: 13) | ATGCGGATATTTCGTT (SEQ ID NO: 532) |
| 118 HOOK2 PROTEIN (SEQ ID NO: 13) | GGATGTGGATATTTTGT (SEQ ID NO: 533) |
| 119 HOOK2 PROTEIN (SEQ ID NO: 13) | ATTTCGTTTTCGGAGT (SEQ ID NO: 534) |
| 120 HOOK2 PROTEIN (SEQ ID NO: 13) | GGATATTTTGTTTTTGGA (SEQ ID NO: 535) |
| 121 HOOK2 PROTEIN (SEQ ID NO: 13) | AGGTAGCGTAAAGGGA (SEQ ID NO: 536) |
| 122 HOOK2 PROTEIN (SEQ ID NO: 13) | AGGTAGTGTAAAGGGA (SEQ ID NO: 537) |
| 123 (SEQ ID NO: 14) | TAACGTATCGTTAGGG (SEQ ID NO: 538) |
| 124 (SEQ ID NO: 14) | AATGTATTGTTAGGGATG (SEQ.ID NO: 539) |
| 125 (SEQ ID NO: 14) | TTTTTGGCGCGGAGTA (SEQ ID NO: 540) |
| 126 (SEQ ID NO: 14) | TTTTGGTGTGGAGTAG (SEQ ID NO: 541) |
| 127 (SEQ ID NO: 14) | TAGAGTTCGACGGGTT (SEQ ID NO: 542) |
| 128 (SEQ ID NO: 14) | AGAGTTTGATGGGTTT (SEQ ID NO: 543) |
| 129 (SEQ ID NO: 14) | ATCGAATTTATCGGTCGG (SEQ ID NO: 544) |
| 130 (SEQ ID NO: 14) | ATTGAATTTATTGGTTGG (SEQ ID NO: 545) |
| 131 (SEQ ID NO: 14) | TATTACGGGGAACGGT (SEQ ID NO: 546) |
| 132 (SEQ ID NO: 14) | TATTATGGGGAATGGTT (SEQ ID NO: 547) |
| 133 (SEQ ID NO: 14) | GAACGGTTCGTTTTTA (SEQ ID NO: 548) |
| 134 (SEQ ID NO: 14) | GGGAATGGTTTGTTTT (SEQ ID NO: 549) |
| 135 (SEQ ID NO: 14) | AAGGGGATCGTTTTTT (SEQ ID NO: 550) |
| 136 (SEQ ID NO: 14) | TAAGGGGATTGTTTTTT (SEQ ID NO: 551) |

TABLE 9-continued

| Gene name and/or No: SEQ ID NO | Oligo: |
|---|---|
| 137 (SEQ ID NO: 14) | TTTTAGGGCGGTTTAA (SEQ ID NO: 552) |
| 138 (SEQ ID NO: 14) | TTAGGGTGGTTTAAGG (SEQ ID NO: 553) |
| 139 (SEQ ID NO: 15) | TGACGAAAATCGATTG (SEQ ID NO: 554) |
| 140 (SEQ ID NO: 15) | GATGAAAATTGATTGGAT (SEQ ID NO: 555) |
| 141 (SEQ ID NO: 15) | GGGTATACGAATACGT (SEQ ID NO: 556) |
| 142 (SEQ ID NO: 15) | GTGGGTATATGAATATGT (SEQ ID NO: 557) |
| 143 (SEQ ID NO: 15) | TTCGAGGTTACGGGTT (SEQ ID NO: 558) |
| 144 (SEQ ID NO: 15) | TTTGAGGTTATGGGTT (SEQ ID NO: 559) |
| 145 (SEQ ID NO: 15) | TGTTCGAGGTATATACGT (SEQ ID NO: 560) |
| 146 (SEQ ID NO: 15) | TTGTTTGAGGTATATATGT (SEQ ID NO: 561) |
| 147 (SEQ ID NO: 16) | AGGAGATTCGGTTATAT (SEQ ID NO: 562) |
| 148 (SEQ ID NO: 16) | GAGGAGATTTGGTTATAT (SEQ ID NO: 563) |
| 149 (SEQ ID NO: 16) | GTTATTTTCGGTAATGTT (SEQ ID NO: 564) |
| 150 (SEQ ID NO: 16) | AGGTTATTTTTGGTAATG (SEQ ID NO: 565) |
| 151 (SEQ ID NO: 16) | TATTAGTCGTTAGTTTGA (SEQ ID NO: 566) |
| 152 (SEQ ID NO: 16) | TATTAGTTGTTAGTTTGAG (SEQ ID NO: 567) |
| 153 (SEQ ID NO: 16) | AGGTTTATACGATAAAGG (SEQ ID NO: 568) |
| 154 (SEQ ID NO: 16) | AGGTTTATATGATAAAGGT (SEQ ID NO: 569) |
| 155 (SEQ ID NO: 17) | TTCGAATATTAGCGCGT (SEQ ID NO: 570) |
| 156 (SEQ ID NO: 17) | ATTTTGAATATTAGTGTGT (SEQ ID NO: 571) |
| 157 (SEQ ID NO: 17) | TTTATGAGCGGCGAGT (SEQ ID NO: 572) |
| 158 (SEQ ID NO: 17) | GAGTGGTGAGTTTAGG (SEQ ID NO: 573) |
| 159 (SEQ ID NO: 17) | AGTCGGTAACGCGTAT (SEQ ID NO: 574) |
| 160 (SEQ ID NO: 17) | AGAGTTGGTAATGTGTA (SEQ ID NO: 575) |
| 161 (SEQ ID NO: 17) | TTTTTTACGCGGAAGG (SEQ ID NO: 576) |
| 162 (SEQ ID NO: 17) | TTTTATGTGGAAGGGG (SEQ ID NO: 577) |
| 163 LYSOSOMAL-ASSOCIATED MULTITRANSMEMBRANE PROTEIN (RETINOIC ACID-INDUCIBLE E3 PROTEIN) (HA1520) LAM5 (SEQ ID NO: 18) | AGGTCGGTCGTAGATA (SEQ ID NO: 578) |
| 164 LYSOSOMAL-ASSOCIATED MULTITRANSMEMBRANE PROTEIN (RETINOIC ACID-INDUCIBLE E3 PROTEIN) (HA1520) LAM5 (SEQ ID NO: 18) | GAGGTTGGTTGTAGAT (SEQ ID NO: 579) |
| 165 LYSOSOMAL-ASSOCIATED MULTITRANSMEMBRANE PROTEIN (RETINOIC ACID-INDUCIBLE E3 PROTEIN) (HA1520) LAM5 (SEQ ID NO: 18) | GACGTTTATTTCGAGG (SEQ ID NO: 580) |
| 166 LYSOSOMAL-ASSOCIATED MULTITRANSMEMBRANE PROTEIN (RETINOIC ACID-INDUCIBLE E3 PROTEIN) (HA1520) LAM5 (SEQ ID NO: 18) | TGATGTTTATTTTGAGGT (SEQ ID NO: 581) |
| 167 LYSOSOMAL-ASSOCIATED MULTITRANSMEMBRANE PROTEIN (RETINOIC ACID-INDUCIBLE E3 PROTEIN) (HA1520) LAM5 (SEQ ID NO: 18) | TTTGATCGGGATGTGA (SEQ ID NO: 582) |
| 168 LYSOSOMAL-ASSOCIATED MULTITRANSMEMBRANE PROTEIN (RETINOIC ACID-INDUCIBLE E3 PROTEIN) (HA1520) LAM5 (SEQ ID NO: 18) | TTTGATTGGGATGTGA (SEQ ID NO: 583) |
| 169 LYSOSOMAL-ASSOCIATED MULTITRANSMEMBRANE PROTEIN (RETINOIC ACID-INDUCIBLE E3 PROTEIN) (HA1520) LAM5 (SEQ ID NO: 18) | TGTAATTGACGTTTATTT (SEQ ID NO: 584) |
| 170 LYSOSOMAL-ASSOCIATED MULTITRANSMEMBRANE PROTEIN (RETINOIC ACID-INDUCIBLE E3 PROTEIN) (HA1520) LAM5 (SEQ ID NO: 18) | AATGTAATTGATGTTTATTT (SEQ ID NO: 585) |
| 171 "TYPE I INOSITOL-1,4,5-TRISPHOSPHATE 5-PHOSPHATASE (EC 3.1.3.56) (5PTASE) (SEQ ID NO: 19) | ATCGGTGTTAGCGGAT (SEQ ID NO: 586) |
| 172 "TYPE I INOSITOL-1,4,5-TRISPHOSPHATE 5-PHOSPHATASE (EC 3.1.3.56) (5PTASE) (SEQ ID NO: 19) | AATTGGTGTTAGTGGA (SEQ ID NO: 587) |
| 173 "TYPE I INOSITOL-1,4,5-TRISPHOSPHATE 5-PHOSPHATASE (EC 3.1.3.56) (5PTASE) (SEQ ID NO: 19) | ATGTTCGTAGGTGTCGG (SEQ ID NO: 588) |
| 174 "TYPE I INOSITOL-1,4,5-TRISPHOSPHATE 5-PHOSPHATASE (EC 3.1.3.56) (5PTASE) (SEQ ID NO: 19) | TTTGTAGGTGTTGGGTA (SEQ ID NO: 589) |
| 175 "TYPE I INOSITOL-1,4,5-TRISPHOSPHATE 5-PHOSPHATASE (EC 3.1.3.56) (5PTASE) (SEQ ID NO: 19) | GTCGTTGTTATCGAGG (SEQ ID NO: 590) |

TABLE 9-continued

| No | Gene name and/or SEQ ID NO | Oligo: |
|---|---|---|
| 176 | "TYPE I INOSITOL-1,4,5-TRISPHOSPHATE 5-PHOSPHA-TASE (EC 3.1.3.56) (5PTASE) (SEQ ID NO: 19) | GGTTGTTGTTATTGAGG (SEQ ID NO: 591) |
| 177 | "TYPE I INOSITOL-1,4,5-TRISPHOSPHATE 5-PHOSPHA-TASE (EC 3.1.3.56) (5PTASE) (SEQ ID NO: 19) | ATTGCGGTTTTATCGG (SEQ ID NO: 592) |
| 178 | "TYPE I INOSITOL-1,4,5-TRISPHOSPHATE 5-PHOSPHA-TASE (EC 3.1.3.56) (5PTASE) (SEQ ID NO: 19) | ATTGTGGTTTTATTGGT (SEQ ID NO: 593) |
| 179 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TTCGATCGGTTGAATA (SEQ ID NO: 594) |
| 180 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TTGAGTTTTGATTGGTT (SEQ ID NO: 595) |
| 181 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TAAGTCGCGTAAGGAG (SEQ ID NO: 596) |
| 182 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | AAGTTGTGTAAGGAGTA (SEQ ID NO: 597) |
| 183 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | AGGTTCGTTAATCGTT (SEQ ID NO: 598) |
| 184 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TGAGGTTTGTTAATTGT (SEQ ID NO: 599) |
| 185 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TACGTTGGACGTATAG (SEQ ID NO: 600) |
| 186 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | AGAGTATGTTGGATGTA (SEQ ID NO: 601) |
| 187 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | AGTCGCGAGTTATCGA (SEQ ID NO: 602) |
| 188 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | AGTTGTGAGTTATTGAG (SEQ ID NO: 603) |
| 189 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TAGCGCGTCGTATATA (SEQ ID NO: 604) |
| 190 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | GGAGTAGTGTGTTGTAT (SEQ ID NO: 605) |
| 191 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | GTCGAAAGTCGTTGAG (SEQ ID NO: 606) |
| 192 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | GTTGAAAGTTGTTGAGG (SEQ ID NO: 607) |
| 193 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TAGGACGTATCGCGAG (SEQ ID NO: 608) |
| 194 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TAGGATGTATTGTGAGT (SEQ ID NO: 609) |
| 195 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | AGTGTATCGTTTTCGG (SEQ ID NO: 610) |
| 196 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TAGTGTATTGTTTTTGG (SEQ ID NO: 611) |
| 197 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TTCGTTTACGGTAGTT (SEQ ID NO: 612) |
| 198 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | ATTTTTGTTTATGGTAGTT (SEQ ID NO: 613) |
| 199 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | TGCGTATCGTTAGTTA (SEQ ID NO: 614) |
| 200 | PROSTAGLANDIN E2 RECEPTOR, EP4 SUBTYPE (PROSTANOID EP4 RECEPTOR) (PGE RECEP-TOR, EP4 SUBTYPE) (SEQ ID NO: 20) | AGGTTGTGTATTGTTAG (SEQ ID NO: 615) |
| 201 | (SEQ ID NO: 21) | ATTCGGCGAATAGTAG (SEQ ID NO: 616) |

TABLE 9-continued

| No: | Gene name and/or SEQ ID NO | Oligo: |
|---|---|---|
| 202 | (SEQ ID NO: 21) | TATTTGGTGAATAGTAGTA (SEQ ID NO: 617) |
| 203 | (SEQ ID NO: 21) | ATAGCGTTGGTCGTTA (SEQ ID NO: 618) |
| 204 | (SEQ ID NO: 21) | ATAGTGTTGGTTGTTAG (SEQ ID NO: 619) |
| 205 | (SEQ ID NO: 21) | TTCGGGATACGAGTTT (SEQ ID NO: 620) |
| 206 | (SEQ ID NO: 21) | GTTTGGGATATGAGTTT (SEQ ID NO: 621) |
| 207 | (SEQ ID NO: 21) | TACGATAAGTCGGAGA (SEQ ID NO: 622) |
| 208 | (SEQ ID NO: 21) | GGGTTATGATAAGTTGG (SEQ ID NO: 623) |
| 209 | (SEQ ID NO: 22) | TATCGGCGAGTTGTAT (SEQ ID NO: 624) |
| 210 | (SEQ ID NO: 22) | GGTTATTGGTGAGTTG (SEQ ID NO: 625) |
| 211 | (SEQ ID NO: 22) | TTAACGTTTGGGGACGT (SEQ ID NO: 626) |
| 212 | (SEQ ID NO: 22) | TTAATGTTTGGGGATGT (SEQ ID NO: 627) |
| 213 | (SEQ ID NO: 22) | TATTCGCGTTTTTAGAT (SEQ ID NO: 628) |
| 214 | (SEQ ID NO: 22) | TTATTTGTGTTTTTAGATTA (SEQ ID NO: 629) |
| 215 | EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE (SEQ ID NO: 23) | AGGGATAACGGAATATT (SEQ ID NO: 630) |
| 216 | EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE (SEQ ID NO: 23) | GAAGGGATAATGGAATAT (SEQ ID NO: 631) |
| 217 | EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE (SEQ ID NO: 23) | GAATAGTTTCGAGATGA (SEQ ID NO: 632) |
| 218 | EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE (SEQ ID NO: 23) | GGAATAGTTTTGAGATGA (SEQ ID NO: 633) |
| 219 | ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR) (SEQ ID NO: 24) | TTTTCGACGAAGTTTT (SEQ ID NO: 634) |
| 220 | ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR) (SEQ ID NO: 24) | TTTTGATGAAGTTTTGTT (SEQ ID NO: 635) |
| 221 | ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR) (SEQ ID NO: 24) | TTACGGAGGCGTTTTA (SEQ ID NO: 636) |
| 222 | ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR) (SEQ ID NO: 24) | TTTTATGGAGGTGTTTT (SEQ ID NO: 637) |
| 223 | ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR) (SEQ ID NO: 24) | AGGCGAATTTATCGGG (SEQ ID NO: 638) |
| 224 | ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR) (SEQ ID NO: 24) | GGTGAATTTATTGGGG (SEQ ID NO: 639) |
| 225 | ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR) (SEQ ID NO: 24) | TAGTCGAAGTAGGCGT (SEQ ID NO: 640) |
| 226 | ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR) (SEQ ID NO: 24) | TAGTTGAAGTAGGTGTT (SEQ ID NO: 641) |

TABLE 9-continued

| Gene name and/or No:SEQ ID NO | Oligo: |
|---|---|
| TER BINDING FACTOR) (SEQ ID NO: 24) | |
| 227 PROTEIN-TYROSINE PHOSPHA-TASE X PRECURSOR (EC 3.1.3.48) (R-PTP-X) (ISLET CELL AUTOANTIGEN RELATED PROTEIN) (ICAAR) (IAR) (PHOGRIN) (SEQ ID NO: 25) | TTCGATCGAAGGTAAT (SEQ ID NO: 642) |
| 228 PROTEIN-TYROSINE PHOSPHA-TASE X PRECURSOR (EC 3.1.3.48) (R-PTP-X) (ISLET CELL AUTOANTIGEN RELATED PROTEIN) (ICAAR) (IAR) (PHOGRIN) (SEQ ID NO: 25) | TTTGTTTGATTGAAGGT (SEQ ID NO: 643) |
| 229 PROTEIN-TYROSINE PHOSPHA-TASE X PRECURSOR (EC 3.1.3.48) (R-PTP-X) (ISLET CELL AUTOANTIGEN RELATED PROTEIN) (ICAAR) (IAR) (PHOGRIN) (SEQ ID NO: 25) | AGGCGATCGATATTAG (SEQ ID NO: 644) |
| 230 PROTEIN-TYROSINE PHOSPHA-TASE X PRECURSOR (EC 3.1.3.48) (R-PTP-X) (ISLET CELL AUTOANTIGEN RELATED PROTEIN) (ICAAR) (IAR) (PHOGRIN) (SEQ ID NO: 25) | GGTGATTGATATTAGGG (SEQ ID NO: 645) |
| 231 PROTEIN-TYROSINE PHOSPHA-TASE X PRECURSOR (EC 3.1.3.48) (R-PTP-X) (ISLET CELL AUTOANTIGEN RELATED PROTEIN) (ICAAR) (IAR) (PHOGRIN) (SEQ ID NO: 25) | TTAGCGTTCGTCGTTA (SEQ ID NO: 646) |
| 232 PROTEIN-TYROSINE PHOSPHA-TASE X PRECURSOR (EC 3.1.3.48) (R-PTP-X) (ISLET CELL AUTOANTIGEN RELATED PROTEIN) (ICAAR) (IAR) (PHOGRIN) (SEQ ID NO: 25) | TAATTAGTGTTTGTTGTTA (SEQ ID NO: 647) |
| 233 PROTEIN-TYROSINE PHOSPHA-TASE X PRECURSOR (EC 3.1.3.48) (R-PTP-X) (ISLET CELL AUTOANTIGEN RELATED PROTEIN) (ICAAR) (IAR) (PHOGRIN) (SEQ ID NO: 25) | ATCGGTTCGGGAATTT (SEQ ID NO: 648) |
| 234 PROTEIN-TYROSINE PHOSPHA-TASE X PRECURSOR (EC 3.1.3.48) (R-PTP-X) (ISLET CELL AUTOANTIGEN RELATED PROTEIN) (ICAAR) (IAR) (PHOGRIN) (SEQ ID NO: 25) | AGATTGGTTTGGGAAT (SEQ ID NO: 649) |
| 235 (SEQ ID NO: 26) | GTCGATTTCGTTACGG (SEQ ID NO: 650) |
| 236 (SEQ ID NO: 26) | GTTGATTTTGTTATGGG (SEQ ID NO: 651) |
| 237 (SEQ ID NO: 26) | TTCGGGTTTCGTATTA (SEQ ID NO: 652) |
| 238 (SEQ ID NO: 26) | TTTTGGGTTTTGTATTAG (SEQ ID NO: 653) |
| 239 (SEQ ID NO: 26) | AATTCGCGGTTTCGAT (SEQ ID NO: 654) |
| 240 (SEQ ID NO: 26) | AATTTGTGGTTTTGATG (SEQ ID NO: 655) |
| 241 (SEQ ID NO: 26) | GTCGTTTCGCGGAGAT (SEQ ID NO: 656) |
| 242 (SEQ ID NO: 26) | GTTGTTTTGTGGAGATT (SEQ ID NO: 657) |
| 243 (SEQ ID NO: 27) | ATTGGTCGATTCGCGG (SEQ ID NO: 658) |
| 244 (SEQ ID NO: 27) | TATTGGTTGATTTGTGG (SEQ ID NO: 659) |
| 245 (SEQ ID NO: 27) | AGCGTTTCGATTTCGG (SEQ ID NO: 660) |
| 246 (SEQ ID NO: 27) | AGTGTTTTGATTTGGT (SEQ ID NO: 661) |
| 247 (SEQ ID NO: 27) | ATCGAGCGTTTCGATT (SEQ ID NO: 662) |
| 248 (SEQ ID NO: 27) | GGATTGAGTGTTTGAT (SEQ ID NO: 663) |
| 249 (SEQ ID NO: 27) | ATTCGCGTATTCGAGA (SEQ ID NO: 664) |
| 250 (SEQ ID NO: 27) | TTTGTGTATTTGAGAGG (SEQ ID NO: 665) |
| 251 (SEQ ID NO: 27) | GACGTTCGCGATTAAA (SEQ ID NO: 666) |
| 252 (SEQ ID NO: 27) | TGGATGTTTGTGATTAA (SEQ ID NO: 667) |
| 253 (SEQ ID NO: 27) | AAGTCGATATCGCGGT (SEQ ID NO: 668) |
| 254 (SEQ ID NO: 27) | AAAAGTTGATATTGTGGT (SEQ ID NO: 669) |
| 255 (SEQ ID NO: 27) | AGCGTTCGGAAGTTTA (SEQ ID NO: 670) |
| 256 (SEQ ID NO: 27) | GGAGTGTTTGGAAGTT (SEQ ID NO: 671) |
| 257 (SEQ ID NO: 27) | TATTCGGACGGGGATA (SEQ ID NO: 672) |
| 258 (SEQ ID NO: 27) | ATTTGGATGGGGATAG (SEQ ID NO: 673) |
| 259 (SEQ ID NO: 27) | GAGACGCGTAGGTTAT (SEQ ID NO: 674) |
| 260 (SEQ ID NO: 27) | GGGAGATGTGTAGGTT (SEQ ID NO: 675) |
| 261 (SEQ ID NO: 28) | TAGTTTTCGGCGAAGG (SEQ ID NO: 676) |
| 262 (SEQ ID NO: 28) | GGTAGTTTTTGGTGAAG (SEQ ID NO: 677) |

TABLE 9-continued

| No | Gene name and/or SEQ ID NO | Oligo: |
|---|---|---|
| 263 | (SEQ ID NO: 28) | AAGGCGGTGACGTAAA (SEQ ID NO: 678) |
| 264 | (SEQ ID NO: 28) | AAGGTGGTGATGTAAA (SEQ ID NO: 679) |
| 265 | (SEQ ID NO: 28) | ATGGCGTAAGTACGTT (SEQ ID NO: 680) |
| 266 | (SEQ ID NO: 28) | GATGGTGTAAGTATGTT (SEQ ID NO: 681) |
| 267 | (SEQ ID NO: 28) | AGTACGTTCGGGACGA (SEQ ID NO: 682) |
| 268 | (SEQ ID NO: 28) | AAGTATGTTTGGGATGA (SEQ ID NO: 683) |
| 269 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | ATGGTATTCGGGTCGT (SEQ ID NO: 684) |
| 270 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | TATGGTATTTGGGTTGT (SEQ ID NO: 685) |
| 271 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | TTGGAGCGTTAAGTAA (SEQ ID NO: 686) |
| 272 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | TATTTGGAGTGTTAAGTA (SEQ ID NO: 687) |
| 273 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | TGAAAGATTCGTTTGTT (SEQ ID NO: 688) |
| 274 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | GTGAAAGATTTGTTTGTT (SEQ ID NO: 689) |
| 275 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | TGTATAACGAGAGGTG (SEQ ID NO: 690) |
| 276 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | TGTATAATGAGAGGTGA (SEQ ID NO: 691) |
| 277 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | ATGTTTCGGGTATGGA (SEQ ID NO: 692) |
| 278 | PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN) (SEQ ID NO: 29) | ATGTTTTGGGTATGGA (SEQ ID NO: 693) |
| 279 | HOMEOBOX PROTEIN HOX-B6 (HOX-2B) (HOX-2.2) (SEQ ID NO: 30) | TTTTCGAGGAATTCGT (SEQ ID NO: 694) |
| 280 | HOMEOBOX PROTEIN HOX-B6 (HOX-2B) (HOX-2.2) (SEQ ID NO: 30) | TTTTTTGAGGAATTTGTT (SEQ ID NO: 695) |
| 281 | HOMEOBOX PROTEIN HOX-B6 (HOX-2B) (HOX-2.2) (SEQ ID NO: 30) | ATAGTTTTCGGCGGGT (SEQ ID NO: 696) |
| 282 | HOMEOBOX PROTEIN HOX-B6 (HOX-2B) (HOX-2.2) (SEQ ID NO: 30) | TATAGTTTTTGGTGGGT (SEQ ID NO: 697) |
| 283 | HOMEOBOX PROTEIN HOX-B6 (HOX-2B) (HOX-2.2) (SEQ ID NO: 30) | TTTTTCGGCGTAGATA (SEQ ID NO: 698) |
| 284 | HOMEOBOX PROTEIN HOX-B6 (HOX-2B) (HOX-2.2) (SEQ ID NO: 30) | TGTTTTTTGGTGTAGAT (SEQ ID NO: 699) |
| 285 | HOMEOBOX PROTEIN HOX-B6 (HOX-2B) (HOX-2.2) (SEQ ID NO: 30) | TTACGGGCGTTAGAGA (SEQ ID NO: 700) |
| 286 | HOMEOBOX PROTEIN HOX-B6 (HOX-2B) (HOX-2.2) (SEQ ID NO: 30) | GGAGTTATGGGTGTTA (SEQ ID NO: 701) |
| 287 | LIM DOMAIN KINASE 1 (EC 2.7.1.37) (LIMK-1) (SEQ ID NO: 31) | TATCGGATTATCGCGG (SEQ ID NO: 702) |
| 288 | LIM DOMAIN KINASE 1 (EC 2.7.1.37) (LIMK-1) (SEQ ID NO: 31) | ATTGGATTATTGTGGGG (SEQ ID NO: 703) |
| 289 | LIM DOMAIN KINASE 1 (EC 2.7.1.37) (LIMK-1) (SEQ ID NO: 31) | GTCGGTAGTTTATCGGAT (SEQ ID NO: 704) |
| 290 | LIM DOMAIN KINASE 1 (EC 2.7.1.37) (LIMK-1) (SEQ ID NO: 31) | GTTGGTAGTTTATTGGAT (SEQ ID NO: 705) |
| 291 | LIM DOMAIN KINASE 1 (EC 2.7.1.37) (LIMK-1) (SEQ ID NO: 31) | TAGGAGACGTTACGTT (SEQ ID NO: 706) |
| 292 | LIM DOMAIN KINASE 1 (EC 2.7.1.37) (LIMK-1) (SEQ ID NO: 31) | AGATGTTATGTTAGGGT (SEQ ID NO: 707) |
| 293 | LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32) (SEQ ID NO: 32) | AAGAACGGACGTGTTT (SEQ ID NO: 708) |

TABLE 9-continued

| No: | Gene name and/or SEQ ID NO | Oligo: |
|---|---|---|
| 294 | LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32) (SEQ ID NO: 32) | AGGAAGAATGGATGTG (SEQ ID NO: 709) |
| 295 | LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32) (SEQ ID NO: 32) | TTTTTGCGATAGTCGG (SEQ ID NO: 710) |
| 296 | LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32) (SEQ ID NO: 32) | GTTTTTGTGATAGTTGG (SEQ ID NO: 711) |
| 297 | LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32) (SEQ ID NO: 32) | TAGCGGCGATTTAAGG (SEQ ID NO: 712) |
| 298 | LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32) (SEQ ID NO: 32) | GTAGTGGTGATTTAAGG (SEQ ID NO: 713) |
| 299 | LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32) (SEQ ID NO: 32) | TTTACGAGCGAGTCGT (SEQ ID NO: 714) |
| 300 | LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32) (SEQ ID NO: 32) | TTTTATGAGTGAGTTGTT (SEQ ID NO: 715) |
| 301 | 1-ACYL-SN-GLYCEROL-3-PHOSPHATE ACYLTRANSFERASE GAMMA (EC 2.3.1.51) (1-AGP ACYLTRANSFERASE 3) (1-AGPAT 3) (LYSOPHOSPHATIDIC ACID ACYLTRANSFERASE-GAMMA) (LPAAT-GAMMA) (1-ACYL-GLYCEROL-3-PHOSPHATE O-ACYLTRANSFERASE 3) (SEQ ID NO: 33) | TTTCGATAGTATACGGG (SEQ ID NO: 716) |
| 302 | 1-ACYL-SN-GLYCEROL-3-PHOSPHATE ACYLTRANSFERASE GAMMA (EC 2.3.1.51) (1-AGP ACYLTRANSFERASE 3) (1-AGPAT 3) (LYSOPHOSPHATIDIC ACID ACYLTRANSFERASE-GAMMA) (LPAAT-GAMMA) (1-ACYL-GLYCEROL-3-PHOSPHATE O-ACYLTRANSFERASE 3) (SEQ ID NO: 33) | TTTGATAGTATATGGGA (SEQ ID NO: 717) |
| 303 | 1-ACYL-SN-GLYCEROL-3-PHOSPHATE ACYLTRANSFERASE GAMMA (EC 2.3.1.51) (1-AGP ACYLTRANSFERASE 3) (1-AGPAT 3) (LYSOPHOSPHATIDIC ACID ACYLTRANSFERASE-GAMMA) (LPAAT-GAMMA) (1-ACYL-GLYCEROL-3-PHOSPHATE O-ACYLTRANSFERASE 3) (SEQ ID NO: 33) | AAGGGAGCGTTCGTTA (SEQ ID NO: 718) |
| 304 | 1-ACYL-SN-GLYCEROL-3-PHOSPHATE ACYLTRANSFERASE GAMMA (EC 2.3.1.51) (1-AGP ACYLTRANSFERASE 3) (1-AGPAT 3) (LYSOPHOSPHATIDIC ACID ACYLTRANSFERASE-GAMMA) (LPAAT-GAMMA) (1-ACYL-GLYCEROL-3-PHOSPHATE O-ACYLTRANSFERASE 3) (SEQ ID NO: 33) | AAGGGAGTGTTTGTTA (SEQ ID NO: 719) |
| 305 | 1-ACYL-SN-GLYCEROL-3-PHOSPHATE ACYLTRANSFERASE GAMMA (EC 2.3.1.51) (1-AGP ACYLTRANSFERASE 3) (1-AGPAT 3) (LYSOPHOSPHATIDIC ACID ACYLTRANSFERASE-GAMMA) (LPAAT-GAMMA) (1-ACYL-GLYCEROL-3-PHOSPHATE O-ACYLTRANSFERASE 3) (SEQ ID NO: 33) | AATAATAGCGACGGGG (SEQ ID NO: 720) |
| 306 | 1-ACYL-SN-GLYCEROL-3-PHOSPHATE ACYLTRANSFERASE GAMMA (EC 2.3.1.51) (1-AGP ACYLTRANSFERASE 3) (1-AGPAT 3) (LYSOPHOSPHATIDIC ACID ACYLTRANSFERASE-GAMMA) (LPAAT-GAMMA) (1-ACYL-GLYCEROL-3-PHOSPHATE O-ACYLTRANSFERASE 3) (SEQ ID NO: 33) | TAATAGTGATGGGGT (SEQ ID NO: 721) |
| 307 | HOMEOBOX PROTEIN GSH-2 (SEQ ID NO: 34) | TTTAGAATCGTCGAGT (SEQ ID NO: 722) |
| 308 | HOMEOBOX PROTEIN GSH-2 (SEQ ID NO: 34) | AGAATTGTTGAGTGAAG (SEQ ID NO: 723) |
| 309 | HOMEOBOX PROTEIN GSH-2 (SEQ ID NO: 34) | TTTTTCGTCGGTTCGTA (SEQ ID NO: 724) |
| 310 | HOMEOBOX PROTEIN GSH-2 (SEQ ID NO: 34) | TTTGTTGGTTTGTAGGA (SEQ ID NO: 725) |
| 311 | HOMEOBOX PROTEIN GSH-2 (SEQ ID NO: 34) | AGGACGGCGTTTATTA (SEQ ID NO: 726) |
| 312 | HOMEOBOX PROTEIN GSH-2 (SEQ ID NO: 34) | GATGAGGATGGTGTTT (SEQ ID NO: 727) |
| 313 | HOMEOBOX PROTEIN GSH-2 (SEQ ID NO: 34) | TTCGATTTCGGAGGAT (SEQ ID NO: 728) |
| 314 | HOMEOBOX PROTEIN GSH-2 (SEQ ID NO: 34) | TTTGATTTTGGAGGATT (SEQ ID NO: 729) |
| 315 | (SEQ ID NO: 35) | TTCGTTATCGAGAGTT (SEQ ID NO: 730) |
| 316 | (SEQ ID NO: 35) | GGGTTTTGTTATTGAGA (SEQ ID NO: 731) |

TABLE 9-continued

| Gene name and/or No: SEQ ID NO | Oligo: |
|---|---|
| 317 (SEQ ID NO: 35) | GACGTGAGCGTTTAGG (SEQ ID NO: 732) |
| 318 (SEQ ID NO: 35) | GATGTGAGTGTTTAGGG (SEQ ID NO: 733) |
| 319 (SEQ ID NO: 35) | TACGGAGTTGGCGTTA (SEQ ID NO: 734) |
| 320 (SEQ ID NO: 35) | TTTATGGAGTTGGTGT (SEQ ID NO: 735) |
| 321 (SEQ ID NO: 35) | TTGGTTCGTCGAGGAT (SEQ ID NO: 736) |
| 322 (SEQ ID NO: 35) | TTGGTTTGTTGAGGAT (SEQ ID NO: 737) |
| 323 HISTONE H4 (SEQ ID NO: 36) | ATCGAAATCGTAGAGG (SEQ ID NO: 738) |
| 324 HISTONE H4 (SEQ ID NO: 36) | ATTGAAATTGTAGAGGG (SEQ ID NO: 739) |
| 325 HISTONE H4 (SEQ ID NO: 36) | TATGGCGGTGATCGTT (SEQ ID NO: 740) |
| 326 HISTONE H4 (SEQ ID NO: 36) | TTTATGGTGGTGATTGT (SEQ ID NO: 741) |
| 327 HISTONE H4 (SEQ ID NO: 36) | TTACGGCGTTTCGGAT (SEQ ID NO: 742) |
| 328 HISTONE H4 (SEQ ID NO: 36) | TTATGGTGTTTTGGATT (SEQ ID NO: 743) |
| 329 HISTONE H4 (SEQ ID NO: 36) | ATGCGTTTTACGTCGT (SEQ ID NO: 744) |
| 330 HISTONE H4 (SEQ ID NO: 36) | AGATGTGTTTTATGTTGT (SEQ ID NO: 745) |
| 331 HISTONE H4 (SEQ ID NO: 36) | TAAGGCGTCGGATGGT (SEQ ID NO: 746) |
| 332 HISTONE H4 (SEQ ID NO: 36) | GAGTAAGGTGTTGGAT (SEQ ID NO: 747) |
| 333 HISTONE H4 (SEQ ID NO: 36) | TATTTTACGGTGGCGT (SEQ ID NO: 748) |
| 334 HISTONE H4 (SEQ ID NO: 36) | ATTTTATGGTGGTGTTT (SEQ ID NO: 749) |
| 335 POTASSIUM VOLTAGE-GATED CHANNEL SUBFAMILY KQT MEMBER 2 (NEUROBLASTOMA-SPECIFIC POTASSIUM CHANNEL KQT-LIKE 2) (SEQ ID NO: 37) | ATTTCGGAGGTATCGT (SEQ ID NO: 750) |
| 336 POTASSIUM VOLTAGE-GATED CHANNEL SUBFAMILY KQT MEMBER 2 (NEUROBLASTOMA-SPECIFIC POTASSIUM CHANNEL KQT-LIKE 2) (SEQ ID NO: 37) | TTTGGAGGTATTGTGT (SEQ ID NO: 751) |
| 337 POTASSIUM VOLTAGE-GATED CHANNEL SUBFAMILY KQT MEMBER 2 (NEUROBLASTOMA-SPECIFIC POTASSIUM CHANNEL KQT-LIKE 2) (SEQ ID NO: 37) | TTCGTACGGGGTATAG (SEQ ID NO: 752) |
| 338 POTASSIUM VOLTAGE-GATED CHANNEL SUBFAMILY KQT MEMBER 2 (NEUROBLASTOMA-SPECIFIC POTASSIUM CHANNEL KQT-LIKE 2) (SEQ ID NO: 37) | GGTTTGTATGGGGTATA (SEQ ID NO: 753) |
| 339 POTASSIUM VOLTAGE-GATED CHANNEL SUBFAMILY KQT MEMBER 2 (NEUROBLASTOMA-SPECIFIC POTASSIUM CHANNEL KQT-LIKE 2) (SEQ ID NO: 37) | TATAAGGCGTTACGGT (SEQ ID NO: 754) |
| 340 POTASSIUM VOLTAGE-GATED CHANNEL SUBFAMILY KQT MEMBER 2 (NEUROBLASTOMA-SPECIFIC POTASSIUM CHANNEL KQT-LIKE 2) (SEQ ID NO: 37) | GGTATAAGGTGTTATGG (SEQ ID NO: 755) |
| 341 POTASSIUM VOLTAGE-GATED CHANNEL SUBFAMILY KQT MEMBER 2 (NEUROBLASTOMA-SPECIFIC POTASSIUM CHANNEL KQT-LIKE 2) (SEQ ID NO: 37) | TTACGGTCGCGTAGTA (SEQ ID NO: 756) |
| 342 POTASSIUM VOLTAGE-GATED CHANNEL SUBFAMILY KQT MEMBER 2 (NEUROBLASTOMA-SPECIFIC POTASSIUM CHANNEL KQT-LIKE 2) (SEQ ID NO: 37) | TATGGTTGTGTAGTAGT (SEQ ID NO: 757) |
| 343 ADAPTER-RELATED PROTEIN COMPLEX 1 SIGMA 1B SUBUNIT (SIGMA-ADAPTIN 1B) (ADAPTOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA-1B SMALL CHAIN) (SIGMA 1B SUBUNIT OF AP-1 CLATHRIN) (DC22) (SEQ ID NO: 38) | TTATTCGTAGTTTTCGG (SEQ ID NO: 758) |
| 344 ADAPTER-RELATED PROTEIN COMPLEX 1 SIGMA 1B SUBUNIT (SIGMA-ADAPTIN 1B) (ADAPTOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA-1B SMALL CHAIN) (SIGMA 1B SUBUNIT OF AP-1 CLATHRIN) (DC22) (SEQ ID NO: 38) | GTTTATTTGTAGTTTTGG (SEQ ID NO: 759) |
| 345 ADAPTER-RELATED PROTEIN COMPLEX 1 SIGMA 1B SUBUNIT (SIGMA-ADAPTIN 1B) (ADAPTOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA-1B SMALL CHAIN) (SIGMA 1B SUBUNIT OF AP-1 CLATHRIN) (DC22) (SEQ ID NO: 38) | TGTAATCGTTTATTCGT (SEQ ID NO: 760) |
| 346 ADAPTER-RELATED PROTEIN COMPLEX 1 SIGMA 1B SUBUNIT (SIGMA-ADAPTIN 1B) (ADAP- | TAATTGTTTATTTGTAGTTT (SEQ ID NO: 761) |

TABLE 9-continued

| No | Gene name and/or SEQ ID NO | Oligo: |
|---|---|---|
| | TOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA-1B SMALL CHAIN) (SIGMA 1B SUBUNIT OF AP-1 CLATHRIN) (DC22) (SEQ ID NO: 38) | |
| 347 | ADAPTER-RELATED PROTEIN COMPLEX 1 SIGMA 1B SUBUNIT (SIGMA-ADAPTIN 1B) (ADAPTOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA-1B SMALL CHAIN) (SIGMA 1B SUBUNIT OF AP-1 CLATHRIN) (DC22) (SEQ ID NO: 38) | TTCGAAGTCGGATTA (SEQ ID NO: 762) |
| 348 | ADAPTER-RELATED PROTEIN COMPLEX 1 SIGMA 1B SUBUNIT (SIGMA-ADAPTIN 1B) (ADAPTOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA-1B SMALL CHAIN) (SIGMA 1B SUBUNIT OF AP-1 CLATHRIN) (DC22) (SEQ ID NO: 38) | ATTTTGAAGTTGGGATT (SEQ ID NO: 763) |
| 349 | ADAPTER-RELATED PROTEIN COMPLEX 1 SIGMA 1B SUBUNIT (SIGMA-ADAPTIN 1B) (ADAPTOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA-1B SMALL CHAIN) (SIGMA 1B SUBUNIT OF AP-1 CLATHRIN) (DC22) (SEQ ID NO: 38) | ATCGAGAGTATTTCGAAG (SEQ ID NO: 764) |
| 350 | ADAPTER-RELATED PROTEIN COMPLEX 1 SIGMA 1B SUBUNIT (SIGMA-ADAPTIN 1B) (ADAPTOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA-1B SMALL CHAIN) (SIGMA 1B SUBUNIT OF AP-1 CLATHRIN) (DC22) (SEQ ID NO: 38) | GGATTGAGAGTATTTTGA (SEQ ID NO: 765) |
| 351 | (SEQ ID NO: 39) | TAAGCGGTATAAGTCGG (SEQ ID NO: 766) |
| 352 | (SEQ ID NO: 39) | AGTGGTATAAGTTGGTT (SEQ ID NO: 767) |
| 353 | (SEQ ID NO: 39) | TTCGGTAAGCGGTATA (SEQ ID NO: 768) |
| 354 | (SEQ ID NO: 39) | ATAATTTGGTAAGTGGTA (SEQ ID NO: 769) |
| 355 | (SEQ ID NO: 39) | TTCGTGATTTTACGTTA (SEQ ID NO: 770) |
| 356 | (SEQ ID NO: 39) | AATTTTGTGATTTTATGTT (SEQ ID NO: 771) |
| 357 | (SEQ ID NO: 39) | TGGCGACGAAGTGTAA (SEQ ID NO: 772) |
| 358 | (SEQ ID NO: 39) | TTTGTGGTGATGAAGT (SEQ ID NO: 773) |
| 359 | (SEQ ID NO: 40) | TAGCGGGTTTACGGAG (SEQ ID NO: 774) |
| 360 | (SEQ ID NO: 40) | AGTAGTGGGTTTATGG (SEQ ID NO: 775) |
| 361 | (SEQ ID NO: 40) | TAACGAGTCGAGCGGA (SEQ ID NO: 776) |
| 362 | (SEQ ID NO: 40) | AATGAGTTGAGTGGAG (SEQ ID NO: 777) |
| 363 | (SEQ ID NO: 40) | TTTTCGCGTGTAAGTT (SEQ ID NO: 778) |
| 364 | (SEQ ID NO: 40) | TTTTTGTGTGTAAGTTAA (SEQ ID NO: 779) |
| 365 | (SEQ ID NO: 40) | TAGGACGATTCGGATA (SEQ ID NO: 780) |
| 366 | (SEQ ID NO: 40) | AGGATGATTTGGATAGT (SEQ ID NO: 781) |
| 367 | (SEQ ID NO: 40) | TTCGAGTGAAAGCGGTA (SEQ ID NO: 782) |
| 368 | (SEQ ID NO: 40) | TTTGAGTGAAAGTGGTA (SEQ ID NO: 783) |
| 369 | PERIPLAKIN (195 KDA CORNIFIED ENVELOPE PRECURSOR) (190 KDA PARANEOPLASTIC PEMPHIGUS ANTIGEN) (SEQ ID NO: 41) | TTACGTTTTCGTGAAAT (SEQ ID NO: 784) |
| 370 | PERIPLAKIN (195 KDA CORNIFIED ENVELOPE PRECURSOR) (190 KDA PARANEOPLASTIC PEMPHIGUS ANTIGEN) (SEQ ID NO: 41) | TTTTATGTTTTGTGAAAT (SEQ ID NO: 785) |
| 371 | PERIPLAKIN (195 KDA CORNIFIED ENVELOPE PRECURSOR) (190 KDA PARANEOPLASTIC PEMPHIGUS ANTIGEN) (SEQ ID NO: 41) | GGGAGGACGTAGAGTA (SEQ ID NO: 786) |
| 372 | PERIPLAKIN (195 KDA CORNIFIED ENVELOPE PRECURSOR) (190 KDA PARANEOPLASTIC PEMPHIGUS ANTIGEN) (SEQ ID NO: 41) | GGGAGGATGTAGAGTA (SEQ ID NO: 787) |
| 373 | PERIPLAKIN (195 KDA CORNIFIED ENVELOPE PRECURSOR) (190 KDA PARANEOPLASTIC PEMPHIGUS ANTIGEN) (SEQ ID NO: 41) | TGGGTTATCGTTTATATT (SEQ ID NO: 788) |
| 374 | PERIPLAKIN (195 KDA CORNIFIED ENVELOPE PRECURSOR) (190 KDA PARANEOPLASTIC PEMPHIGUS ANTIGEN) (SEQ ID NO: 41) | TTGGGTTATTGTTTATATT (SEQ ID NO: 789) |
| 375 | PERIPLAKIN (195 KDA CORNIFIED ENVELOPE PRECURSOR) | TGGTATCGGTTTTTGAA (SEQ ID NO: 790) |

TABLE 9-continued

| Gene name and/or<br>No: SEQ ID NO | Oligo: |
|---|---|
| (190 KDA PARANEOPLASTIC PEMPHIGUS ANTIGEN) (SEQ ID NO: 41) | |
| 376 PERIPLAKIN (195 KDA CORNI-FIED ENVELOPE PRECURSOR) (190 KDA PARANEOPLASTIC PEMPHIGUS ANTIGEN) (SEQ ID NO: 41) | TGGTATTGGTTTTTGAA (SEQ ID NO: 791) |
| 377 PERIPLAKIN (195 KDA CORNI-FIED ENVELOPE PRECURSOR) (190 KDA PARANEOPLASTIC PEMPHIGUS ANTIGEN) (SEQ ID NO: 41) | GTTTAGGTTCGAGTTTA (SEQ ID NO: 792) |
| 378 PERIPLAKIN (195 KDA CORNI-FIED ENVELOPE PRECURSOR) (190 KDA PARANEOPLASTIC PEMPHIGUS ANTIGEN) (SEQ ID NO: 41) | GGTTTAGGTTTGAGTTTA (SEQ ID NO: 793) |
| 379 (SEQ ID NO: 42) | AGAATTGCGACGGTTT (SEQ ID NO: 794) |
| 380 (SEQ ID NO: 42) | AATTGTGATGGTTTGTA (SEQ ID NO: 795) |
| 381 (SEQ ID NO: 42) | TTACGTTTATTTACGGG (SEQ ID NO: 796) |
| 382 (SEQ ID NO: 42) | TATGTTTATTTATGGGAT (SEQ ID NO: 797) |
| 383 (SEQ ID NO: 42) | TGGATGTGCGGAAGAA (SEQ ID NO: 798) |
| 384 (SEQ ID NO: 42) | GATGTGTGGAAGAAGT (SEQ ID NO: 799) |
| 385 (SEQ ID NO: 42) | ATGGGTACGTTGTTTA (SEQ ID NO: 800) |
| 386 (SEQ ID NO: 42) | TATGGGTATGTTGTTTAT (SEQ ID NO: 801) |
| 387 (SEQ ID NO: 42) | GGATATTTGCGTTAGTA (SEQ ID NO: 802) |
| 388 (SEQ ID NO: 42) | GGATATTTGTGTTAGTATT (SEQ ID NO: 803) |
| 389 (SEQ ID NO: 43) | GACGTGTTCGGGTTTTA (SEQ ID NO: 804) |
| 390 (SEQ ID NO: 43) | GATGTGTTTGGGTTTTA (SEQ ID NO: 805) |
| 391 (SEQ ID NO: 43) | AGTCGACGGTTTGAGG (SEQ ID NO: 806) |
| 392 (SEQ ID NO: 43) | AGTTGATGGTTTGAGG (SEQ ID NO: 807) |
| 393 (SEQ ID NO: 43) | TTATTGCGTTGTTAAGT (SEQ ID NO: 808) |
| 394 (SEQ ID NO: 43) | GTTATTGTGTTGTTAAGT (SEQ ID NO: 809) |
| 395 (SEQ ID NO: 44) | ATTTAAACGGGGTCGT (SEQ ID NO: 810) |
| 396 (SEQ ID NO: 44) | AATTTAAATGGGGTTGT (SEQ ID NO: 811) |
| 397 (SEQ ID NO: 44) | ATCGGTTTTTGTATCGAATA (SEQ ID NO: 812) |
| 398 (SEQ ID NO: 44) | ATTGGTTTTTGTATTGAATA (SEQ ID NO: 813) |
| 399 (SEQ ID NO: 44) | TTCGGCGTTTTCGTAG (SEQ ID NO: 814) |
| 400 (SEQ ID NO: 44) | TGAAAGTTCGGCGTTT (SEQ ID NO: 815) |
| 401 (SEQ ID NO: 44) | TTTGGTGTTTTTGTAGG (SEQ ID NO: 816) |
| 402 (SEQ ID NO: 44) | TGAAAGTTGGTGTTTT (SEQ ID NO: 817) |
| 403 (SEQ ID NO: 45) | ATCGGTTTTTCGAGGT (SEQ ID NO: 818) |
| 404 (SEQ ID NO: 45) | ATTGGTTTTTTGAGGTT (SEQ ID NO: 819) |
| 405 (SEQ ID NO: 45) | GGTCGATTTTCGCGTA (SEQ ID NO: 820) |
| 406 (SEQ ID NO: 45) | TGGTTGATTTTGTGTA (SEQ ID NO: 821) |
| 407 (SEQ ID NO: 46) | GGTAATTTCGCGTATT (SEQ ID NO: 822) |
| 408 (SEQ ID NO: 46) | TTGGTAATTTTGTGTATTT (SEQ ID NO: 823) |
| 409 (SEQ ID NO: 47) | TATGCGTATACGTGGT (SEQ ID NO: 824) |
| 410 (SEQ ID NO: 47) | ATGTGTATATGTGGTTTT (SEQ ID NO: 825) |
| 411 (SEQ ID NO: 47) | GTCGTTTTATGCGTAT (SEQ ID NO: 826) |
| 412 (SEQ ID NO: 47) | TGGTTGTTTTATGTGTAT (SEQ ID NO: 827) |
| 413 (SEQ ID NO: 47) | TAGTTTTCGAATTTCGT (SEQ ID NO: 828) |
| 414 (SEQ ID NO: 47) | ATTAGTTTTTGAATTTTGT (SEQ ID NO: 829) |
| 415 (SEQ ID NO: 48) | TAGCGAGGGTCGTTTT (SEQ ID NO: 830) |
| 416 (SEQ ID NO: 48) | TAGTGAGGGTTGTTTT (SEQ ID NO: 831) |
| 417 (SEQ ID NO: 48) | TTAGGTCGCGTCGGTA (SEQ ID NO: 832) |
| 418 (SEQ ID NO: 48) | AGGTTGTGTTGGTAGA (SEQ ID NO: 833) |
| 419 (SEQ ID NO: 48) | ATTTCGTTTACGTCGT (SEQ ID NO: 834) |
| 420 (SEQ ID NO: 48) | GGATTTGTTTATGTTGT (SEQ ID NO: 835) |
| 421 (SEQ ID NO: 48) | TTTTCGTATTCGGGTA (SEQ ID NO: 836) |

TABLE 9-continued

| No | Gene name and/or SEQ ID NO | Oligo: |
|---|---|---|
| 422 | (SEQ ID NO: 48) | TTTGTATTTGGGTAAAAG (SEQ ID NO: 837) |
| 423 | (SEQ ID NO: 48) | AGGATCGGGATTCGTA (SEQ ID NO: 838) |
| 424 | (SEQ ID NO: 48) | AGGATTGGGATTTGTAG (SEQ ID NO: 839) |
| 425 | (SEQ ID NO: 48) | TTCGTTTAAGCGGGGT (SEQ ID NO: 840) |
| 426 | (SEQ ID NO: 48) | TTTGTTTAAGTGGGGT (SEQ ID NO: 841) |
| 427 | (SEQ ID NO: 49) | ATATTCGTGCGGTCGG (SEQ ID NO: 842) |
| 428 | (SEQ ID NO: 49) | ATATTTGTGTGGTTGGA (SEQ ID NO: 843) |
| 429 | (SEQ ID NO: 49) | TTAGGTCGTGGAATGT (SEQ ID NO: 844) |
| 430 | (SEQ ID NO: 49) | TTAGGTTGTGGAATGT (SEQ ID NO: 845) |
| 431 | (SEQ ID NO: 49) | AGGAATCGTGAGTAGG (SEQ ID NO: 846) |
| 432 | (SEQ ID NO: 49) | AGGAATTGTGAGTAGG (SEQ ID NO: 847) |
| 433 | DNA REPLICATION FACTOR; DOUBLE PARKED, DROSOPHILA, HOMOLOG OF (SEQ ID NO: 50) | TTCGATATCGAGTCGG (SEQ ID NO: 848) |
| 434 | DNA REPLICATION FACTOR; DOUBLE PARKED, DROSOPHILA, HOMOLOG OF (SEQ ID NO: 50) | ATTTGATATTGAGTTGGT (SEQ ID NO: 849) |
| 435 | DNA REPLICATION FACTOR; DOUBLE PARKED, DROSOPHILA, HOMOLOG OF (SEQ ID NO: 50) | ATTCGCGTTTTAACGT (SEQ ID NO: 850) |
| 436 | DNA REPLICATION FACTOR; DOUBLE PARKED, DROSOPHILA, HOMOLOG OF (SEQ ID NO: 50) | TTTGTGTTTTAATGTGGA (SEQ ID NO: 851) |
| 437 | DNA REPLICATION FACTOR; DOUBLE PARKED, DROSOPHILA, HOMOLOG OF (SEQ ID NO: 50) | TTCGGTTGGGACGTAA (SEQ ID NO: 852) |
| 438 | DNA REPLICATION FACTOR; DOUBLE PARKED, DROSOPHILA, HOMOLOG OF (SEQ ID NO: 50) | TTTGGTTGGGATGTAA (SEQ ID NO: 853) |
| 439 | DNA REPLICATION FACTOR; DOUBLE PARKED, DROSOPHILA, HOMOLOG OF (SEQ ID NO: 50) | TTAAGGCGTTTAGCGA (SEQ ID NO: 854) |
| 440 | DNA REPLICATION FACTOR; DOUBLE PARKED, DROSOPHILA, HOMOLOG OF (SEQ ID NO: 50) | TTTTAAGGTGTTTAGTGA (SEQ ID NO: 855) |
| 441 | PR-DOMAIN ZINC FINGER PROTEIN 16 (TRANSCRIPTION FACTOR MEL1) (SEQ ID NO: 51) | TATCGTCGAGTGTGTA (SEQ ID NO: 856) |
| 442 | PR-DOMAIN ZINC FINGER PROTEIN 16 (TRANSCRIPTION FACTOR MEL1) (SEQ ID NO: 51) | GGGGTTATTGTTGAGT (SEQ ID NO: 857) |
| 443 | PR-DOMAIN ZINC FINGER PROTEIN 16 (TRANSCRIPTION FACTOR MEL1) (SEQ ID NO: 51) | TATTATTCGAGTTAGAGG (SEQ ID NO: 858) |
| 444 | PR-DOMAIN ZINC FINGER PROTEIN 16 (TRANSCRIPTION FACTOR MEL1) (SEQ ID NO: 51) | TTATTATTTGAGTTAGAGG (SEQ ID NO: 859) |
| 445 | PR-DOMAIN ZINC FINGER PROTEIN 16 (TRANSCRIPTION FACTOR MEL1) (SEQ ID NO: 51) | AGGATTCGTTGAAGAA (SEQ ID NO: 860) |
| 446 | PR-DOMAIN ZINC FINGER PROTEIN 16 (TRANSCRIPTION FACTOR MEL1) (SEQ ID NO: 51) | GTAGGATTTGTTGAAGA (SEQ ID NO: 861) |
| 447 | PR-DOMAIN ZINC FINGER PROTEIN 16 (TRANSCRIPTION FACTOR MEL1) (SEQ ID NO: 51) | TTATTAGGCGATATTTTAA (SEQ ID NO: 862) |
| 448 | PR-DOMAIN ZINC FINGER PROTEIN 16 (TRANSCRIPTION FACTOR MEL1) (SEQ ID NO: 51) | TATTAGGTGATATTTTAAGT (SEQ ID NO: 863) |
| 449 | TUMOR SUPPRESSING SUBTRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | TAGTACGTTGGTTCGG (SEQ ID NO: 864) |
| 450 | TUMOR SUPPRESSING SUBTRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | TATGTTGGTTTGGAGT (SEQ ID NO: 865) |
| 451 | TUMOR SUPPRESSING SUBTRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | AGTTGTTCGATGATTAG (SEQ ID NO: 866) |

TABLE 9-continued

| No | Gene name and/or SEQ ID NO | Oligo: |
|---|---|---|
| 452 | TUMOR SUPPRESSING SUB-TRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | TTTAGTTGTTTGATGATTA (SEQ ID NO: 867) |
| 453 | TUMOR SUPPRESSING SUB-TRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | AGATTAGTACGTTGGTT (SEQ ID NO: 868) |
| 454 | TUMOR SUPPRESSING SUB-TRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | AAGATTAGTATGTTGGTT (SEQ ID NO: 869) |
| 455 | TUMOR SUPPRESSING SUB-TRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | TTAAAGCGGGGAGTTT (SEQ ID NO: 870) |
| 456 | TUMOR SUPPRESSING SUB-TRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | GTTTAAAGTGGGGAGT (SEQ ID NO: 871) |
| 457 | TUMOR SUPPRESSING SUB-TRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | AGATGGTATCGTTTAGG (SEQ ID NO: 872) |
| 458 | TUMOR SUPPRESSING SUB-TRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN (SEQ ID NO: 52) | ATGGTATTGTTTAGGTG (SEQ ID NO: 873) |
| 459 | CDH1 (SEQ ID NO: 54) | TATCGCGTTTATGCGA (SEQ ID NO: 874) |
| 460 | CDH1 (SEQ ID NO: 54) | ATTGTGTTTATGTGAGG (SEQ ID NO: 875) |
| 461 | CDH1 (SEQ ID NO: 54) | TTATGCGAGGTCGGGT (SEQ ID NO: 876) |
| 462 | CDH1 (SEQ ID NO: 54) | TTATGTGAGGTTGGGT (SEQ ID NO: 877) |
| 463 | CDH1 (SEQ ID NO: 54) | TTAATTAGCGGTACGG (SEQ ID NO: 878) |
| 464 | CDH1 (SEQ ID NO: 54) | AATTAGTGGTATGGGG (SEQ ID NO: 879) |
| 465 | CDH1 (SEQ ID NO: 54) | TAGTGGCGTCGGAATT (SEQ ID NO: 880) |
| 466 | CDH1 (SEQ ID NO: 54) | TAGTGGTGTTGGAATT (SEQ ID NO: 881) |
| 467 | CDKN2a (SEQ ID NO: 55) | GGCGTTGTTTAACGTAT (SEQ ID NO: 882) |
| 468 | CDKN2a (SEQ ID NO: 55) | GGGTGTTGTTTAATGTA (SEQ ID NO: 883) |
| 469 | CDKN2a (SEQ ID NO: 55) | TGTTTAACGTATCGAAT (SEQ ID NO: 884) |
| 470 | CDKN2a (SEQ ID NO: 55) | GTTGTTTAATGTATTGAAT (SEQ ID NO: 885) |
| 471 | CDKN2a (SEQ ID NO: 55) | AATAGTTACGGTCGGA (SEQ ID NO: 886) |
| 472 | CDKN2a (SEQ ID NO: 55) | AGTTATGGTTGGAGGT (SEQ ID NO: 887) |
| 473 | CDKN2a (SEQ ID NO: 55) | GTCGGAGGTCGATTTA (SEQ ID NO: 888) |

TABLE 9-continued

| Gene name and/or<br>No: SEQ ID NO | Oligo: |
|---|---|
| 474 CDKN2a (SEQ ID NO: 55) | GGTTGGAGGTTGATTTA (SEQ ID NO: 889) |
| 475 CD44 (SEQ ID NO: 56) | AGGTATTTCGCGATAT (SEQ ID NO: 890) |
| 476 CD44 (SEQ ID NO: 56) | AGGTATTTTGTGATATTTT (SEQ ID NO: 891) |
| 477 CD44 (SEQ ID NO: 56) | TAGGTTCGGTTCGTTAT (SEQ ID NO: 892) |
| 478 CD44 (SEQ ID NO: 56) | TAGGTTTGGTTTGTTATT (SEQ ID NO: 893) |
| 479 CD44 (SEQ ID NO: 56) | GTTCGTTTCGGATATTA (SEQ ID NO: 894) |
| 480 CD44 (SEQ ID NO: 56) | TTTGTTTTGGATATTATGG (SEQ ID NO: 895) |
| 481 CD44 (SEQ ID NO: 56) | TTTGGCGTAGATCGGT (SEQ ID NO: 896) |
| 482 CD44 (SEQ ID NO: 56) | TTTGGTGTAGATTGGT (SEQ ID NO: 897) |
| 483 CD44 (SEQ ID NO: 56) | TTTAGCGCGGATTCGG (SEQ ID NO: 898) |
| 484 CD44 (SEQ ID NO: 56) | GTTTAGTGTGGATTTGG (SEQ ID NO: 899) |
| 485 GSTP1 (SEQ ID NO: 57) | ATCGTTGCGATTTCGG (SEQ ID NO: 900) |
| 486 GSTP1 (SEQ ID NO: 57) | ATTGTTGTGATTTTGGA (SEQ ID NO: 901) |
| 487 GSTP1 (SEQ ID NO: 57) | AGTGTGCGTAGCGAAT (SEQ ID NO: 902) |
| 488 GSTP1 (SEQ ID NO: 57) | GTGTGTAGTGAATTGG (SEQ ID NO: 903) |
| 489 GSTP1 (SEQ ID NO: 57) | GAGTCGTCGCGTAGTT (SEQ ID NO: 904) |
| 490 GSTP1 (SEQ ID NO: 57) | GGAGTTGTTGTGTAGTT (SEQ ID NO: 905) |
| 491 GSTP1 (SEQ ID NO: 57) | ATTTTCGTCGGTTTTAG (SEQ ID NO: 906) |
| 492 GSTP1 (SEQ ID NO: 57) | GGATTTTGTTGGTTTTA (SEQ ID NO: 907) |
| 493 GSTP1 (SEQ ID NO: 57) | TTCGCGGTTTTCGAGT (SEQ ID NO: 908) |
| 494 GSTP1 (SEQ ID NO: 57) | TTTGTGGTTTTTGAGTT (SEQ ID NO: 909) |
| 495 GSTP1 (SEQ ID NO: 57) | TAGCGAAGTTTCGCGG (SEQ ID NO: 910) |
| 496 GSTP1 (SEQ ID NO: 57) | AGTGAAGTTTTGTGGT (SEQ ID NO: 911) |
| 497 GSTP1 (SEQ ID NO: 57) | GTCGCGCGTATTTATT (SEQ ID NO: 912) |
| 498 GSTP1 (SEQ ID NO: 57) | GGGTTGTGTGTATTTAT (SEQ ID NO: 913) |
| 499 IGF2 (SEQ ID NO: 58) | TACGTATAAAATTTCGTATT (SEQ ID NO: 914) |
| 500 IGF2 (SEQ ID NO: 58) | AAATTATGTATAAAATTTTGT (SEQ ID NO: 915) |
| 501 IGF2 (SEQ ID NO: 58) | ATAGACGCGAGTTCGG (SEQ ID NO: 916) |
| 502 IGF2 (SEQ ID NO: 58) | AGATGTGAGTTTGGTT (SEQ ID NO: 917) |
| 503 IGF2 (SEQ ID NO: 58) | TATCGGGGTGCGTTTA (SEQ ID NO: 918) |
| 504 IGF2 (SEQ ID NO: 58) | ATTGGGGTGTGTTTAA (SEQ ID NO: 919) |
| 505 IGF2 (SEQ ID NO: 58) | TTACGGAGGTTTCGGT (SEQ ID NO: 920) |
| 506 IGF2 (SEQ ID NO: 58) | TTATGGAGGTTTTGGT (SEQ ID NO: 921) |
| 507 AR (SEQ ID NO: 53) | TTATAGTCGTAGTCGGT (SEQ ID NO: 922) |
| 508 AR (SEQ ID NO: 53) | AGTTGTAGTTGGTTTTG (SEQ ID NO: 923) |
| 509 AR (SEQ ID NO: 53) | GTCGTGGTCGTTAGTA (SEQ ID NO: 924) |
| 510 AR (SEQ ID NO: 53) | GTTGTGGTTGTTAGTAA (SEQ ID NO: 925) |
| 511 AR (SEQ ID NO: 53) | TATTTTCGGACGAGGA (SEQ ID NO: 926) |
| 512 AR (SEQ ID NO: 53) | AGTATTTTTGGATGAGG (SEQ ID NO: 927) |

Example 4

In the following analysis the methylation status of the genes according to Table 10 were analysed by means of methylation specific polymerase chain reaction using the primers according to Table 10 (below).

The study was run on 50 prostate cancer and 50 Benign Prostate Hyperplasia (BPH) tissue samples. Genomic DNA was analyzed using the MSP technique after bisulfite conversion. The bisulfite process converts unmethylated cytosines to uracil while methylated cytosines remained conserved. Bisulfite treatment was performed with minor modifications according to the protocol described in Olek et al. (1996). Sequences of interest were then amplified by means of methylation specific primers, and the amplificate is detected by means of Taqman probes (see Table 10).

TABLE 10

| Genomic SEQ ID NO: | Primer | Primer | Taqman probe |
|---|---|---|---|
| 20 | Cgcgctactccgcat aca (SEQ ID NO: 958) | Gaggtaatcgaggcggt cg (SEQ ID NO: 959) | 56-FAM/cgccaattcatacgc cgcacc/3BHQ (SEQ ID NO: 960) |
| 36 | Accgaaaatacgctt cacg (SEQ ID NO: 961) | Gcgttatcgtaaagtat tgcgc (SEQ ID NO: 962) | /56-FAM/cgcgacgaacaaaac gccg/3BHQ_1/ (SEQ ID NO: 963) |
| 36 | Gcgttttacgtcgtc gcg (SEQ ID NO: 964) | Gacgctaaacgccaccg t (SEQ ID NO: 965) | /56-FAM/ccgaccatccgacgc cttactcg/3BHQ_1/ (SEQ ID NO: 966) |
| 51 | Cgaatttataccgaa cgctcctacg (SEQ ID NO: 967) | Aggttacgggaggtcga ggtcg (SEQ ID NO: 968) | 56-FAM/ cccgccatcgaccgttccc gacccta/3BHQ (SEQ ID NO: 969) |
| 51 | Tcccgaatttataac gaacg (SEQ ID NO: 970) | Ttttatttaggggtcgg gaac (SEQ ID NO: 971) | 56-FAM/ acgccccgccatcgaccg/ 3BHQ_1 (SEQ ID NO: 972) |
| 24 | Ttgtggttcgggaag agac (SEQ ID NO: 973) | Cttcgatcgaaaaaaac cg (SEQ ID NO: 974) | 56-FAM/ aactacgcgcaaacccgcg a/3BHQ (SEQ ID NO: 975) |
| 31 | Cgtttttcgttttat tttcgc (SEQ ID NO: 976) | Gacaaaaaacgccacgt c (SEQ ID NO: 977) | 56-FAM/ccgacaattcaccga atcaccg/3BHQ_1 (SEQ ID NO: 978) |
| 11 | Atctcacctaccgtc gcg (SEQ ID NO: 979) | Taggagtgcgatcgttt gc (SEQ ID NO: 980) | 56-FAM/acgaacgttacgacc gatacccaacta/3BHQ (SEQ ID NO: 981) |
| 4 | Aacgtatccagacaa tccg (SEQ ID NO: 982) | Gagtatttaaggtttag tgaaacgttagc (SEQ ID NO: 983) | 56-FAM/ caaataacgcgacaataaa cgcataattc/3BHQ_1 (SEQ ID NO: 984) |
| 4 | Tgttttcggagtgcg ttc (SEQ ID NO: 985) | Aaatcaaaccgacgata cga (SEQ ID NO: 986) | 56-FAM/ ccgataaaacgcgtccaaa ccg/3BHQ (SEQ ID NO: 987) |

The term BHQ denotes Black Hole Quencher (BHQ™) dyes, FAM is a commonly used fluorophore dye molecule.

Reagents:

A standard set of reagent and cycling conditions are used for MSP establishment and template amplification. Standard conditions are outlined in Tables 11 & 12. Prior to running biological samples, amplicons were established using 100 picograms of completely methylated DNA as a positive control and and 100 nanograms of unmethylated DNA as a negative control. Reaction conditions were also checked for relative sensitivity using 50 picograms of methylated DNA in a background of 50 nanograms of unmethylated DNA. Reagent concentrations are outlined in Table 11 and cycling conditions for the ABI 7700 are defined in Table 12.

TABLE 11

Reagent concentrations.

| Reagent | Stock Conc. (uM) | Final Rx Conc. (nM) | MM Conc. (uM) | MM Volume (uL) |
|---|---|---|---|---|
| Forward | 10.0 | 500.0 | 3.33 | 35.0 |
| Reverse | 10.0 | 500.0 | 3.33 | 35.0 |
| Probe | 100.0 | 400.0 | 2.67 | 2.8 |
| Water | — | — | — | 32.2 |
| Taqmix | — | — | — | 245.0 |
| Total | — | — | — | 350.0 |

TABLE 12

Cycling conditions

| Temperature (C.) | Time (sec) | # of Cycles |
|---|---|---|
| Denature | | 1 |
| 95 | 600 | |
| Annealing | | 50 |
| 95 | 10 | |
| 60 or 63 | 45 | |

Data Analysis:

Class Prediction by Supervised Learning

In order to give a reliable estimate of how well the CpG ensemble of a selected marker can differentiate between different tissue classes we can determine its prediction accuracy by classification. For that purpose we calculate a methylation profile-based prediction function using a certain set of tissue samples with a specific class label. This step is called training and it exploits the prior knowledge represented by the data labels. The prediction accuracy of that function is then tested on a set of independent samples. As a method of choice, we use the support vector machine (SVM) algorithm (see e.g. Cristiannini, N. and Shawe-Taylor, J. An introduction to support vector machines. Cambridge, UK: Cambridge University Press, 2000.; Duda, R. O., Hart, P. E., and Stork, D. G. Pattern Classification. New York: John Wiley & Sons, 2001.) to learn the prediction function. For this report, sensitivity and specificity are weighted equally. This is achieved by setting the risk associated with false positive and false negative classifications to be inversely proportional to the respective class sizes. Therefore sensitivity and specificity of the resulting classifier can be expected to be approximately equal. Note that this weighting can be adapted according to the clinical requirements.

Results

To determine sensitivity and specificity of said markers, 50 prostate cancer and 50 BPH samples were screened using the defined parameters. Samples had been pre-screened following a technical criterion of methylated DNA vs. unmethylated DNA. After ensuring they were specific for methylated DNA while not amplifying common unmethylated DNA, assays were run using MethyLight realtime PCR on a TaqMan platform (ABI7900). Final assay performance is outlined in Table 13. AUC and corresponding sensitivity and specificity values were calculated using the SVM algorithms.

TABLE 13

| Gene name | Genomic SEQ ID NO: | AUC | Sensitivity | Specificity |
|---|---|---|---|---|
| PROSTAGLANDIN E2 RECEPTOR, EP4 SUBTYPE | 20 | 0.921 | 0.829 | 0.871 |
| HISTONE H4 | 36 | 0.918 | 0.88 | 0.719 |
| PR-DOMAIN ZINC FINGER PROTEIN 16 | 51 | 0.871 | 0.768 | 0.822 |
| ORPHAN NUCLEAR RECEPTOR NR5A2 | 24 | 0.859 | 0.694 | 0.878 |
| LIM DOMAIN KINASE 1 | 31 | 0.868 | 0.791 | 0.755 |
| Genomic region | 11 | 0.842 | 0.815 | 0.704 |
| LIM/HOMEOBOX PROTEIN LHX9 | 4 | 0.745 | 0.695 | 0.653 |

Example 5

The objective of the following study was to analyze the methylation status of prostate cancer markers in different body fluid samples in order to identify the preferred choice of body fluid (urine or serum) for testing and the preferred marker, markers or combinations of markers. The study was run on matched serum and urine sediment samples from 80 patients with an average age of 65 and representative of a number of racial types (Caucasian, african american etc.). In each case, genomic DNA was analyzed using the HeavyMethyl or MSP technique after bisulfite conversion.

Urine Sediment was prepared for analysis and bisulphite treated according to the following:
  200 ul sediment samples were purified using the Magnapure DNA Isolation Kit 1 with a 100 ul elution volume.
  5 ul HD6 PCR was carried out on the Magnapure Eluate, in order to determine DNA concentration
  100 ul of the DNA solution was treated using the bisulfite treatment technique
  10 ul C3 bisulfite specific quantitative PCR
  5 ul 'Merck sulfite test'

Serum was prepared for analysis and bisulphite treated according to the following:
  1 mL serum samples were purified using the Magnapure DNA Large Volume Total nucleic acid with a 100 ul elution volume.
  5 ul HD6 PCR on Magnapure Eluate—To determine DNA concentration
  100 ul of the DNA solution was treated using a proprietary bisulfite treatment technique
  10 ul C3 bisulfite specific quantitative PCR
  5 ul 'Merck sulfite test'

HD6 is a genomic assay that amplifies non-bisulfite converted DNA. It is used to quantitate DNA after the initial extraction. It is specific for the beta-globulin gene.

C3 is a bisulfite specific assay located near exon 4 of the GSTP1 gene. It was used in a fashion similar to our HB14 assay which is also used to quantitate bisulfite converted DNA.

Both require the use of a standard curve and then location of amplification curves and corresponding concentration is used to give a quantitative value for DNA samples.

Single PCR runs were performed on 10 ul of bisulfite treated DNA per sample for each of the markers as described below.

Heavy Methyl Assay of the GSTP1 Gene

In the following analysis the methylation status of the gene GSTP1 was analysed by means of methylation specific amplification using the primers according to Table 1 (below).

The sequence of interest is amplified by means of methylation specific primers and a blocker oligonucleotide in order to minimise the unspecific amplification of non methylated DNA. The amplificate is then detected by means of methylation specific Lightcycler probes.

TABLE 14

Oligonucleotides for HeavyMethyl ™-Lightcycler ™ analysis of GSTP1.

| SEQ ID NO: | Sequence | Type |
|---|---|---|
| 988 | gggattatttttataaggtt | primer |
| 989 | ctctaaacccatcccc | primer |
| 990 | cccatccccaaaaacacaaaccac | blocker |

TABLE 14-continued

Oligonucleotides for HeavyMethyl ™-Lightcycler ™ analysis of GSTP1.

| SEQ ID NO: | Sequence | Type |
|---|---|---|
| 991 | CGtCGtCGtAGTtTTCGtt-fluo | probe |
| 992 | red640-tAGTGAGTACGCGCGGtt-pho | probe |

Reaction Conditions:
PCR Program

| denat at 95° C. | | |
|---|---|---|
| 95 °C. | 10 min | |
| 50 cycles: | ramp | |
| denat at 95 °C. | 10 sec | (1° C./s) |
| annealing 56 C° C. | 30 sec | (1° C./s) detection |
| extension 72° C. | 10 sec | (1° C./s) |

MSP Analysis of the Gene HISTONE H4.

In the following analysis the methylation status of the gene HISTONE H4 was analysed by means of methylation specific amplification using the primers according to Table 15 (below).

The sequence of interest is amplified by means of methylation specific primers, the amplificate is then detected by means of methylation specific Taqman probes

TABLE 15

Oligonucleotides for MSP - Taqman analysis of HISTONE H4.

| SEQ ID NO: | Sequence | Type |
|---|---|---|
| 993 | accgaaaatacgcttcacg | primer |
| 994 | gcgttatcgtaaagtattgcgc | primer |
| 995 | /56-FAM/cgcgacgaacaaaacgccg/3BHQ_1/ | probe |

Reaction Conditions:
PCR Program

| denat at 95° C. | | |
|---|---|---|
| 95° C. | 10 min | |
| 50 cycles: | ramp | |
| denat at 95° C. | 10 sec | (20° C./s) |
| annealing 60C° C. | 45 sec | (20° C./s) detection |

MSP Analysis of the Gene PROSTAGLANDIN E2 RECEPTOR.

In the following analysis the methylation status of the gene PROSTAGLANDIN E2 RECEPTOR was analysed by means of methylation specific amplification using the primers according to Table 16 (below).

The sequence of interest is amplified by means of methylation specific primers, the amplificate is then detected by means of methylation specific Taqman probes.

TABLE 16A

Oligonucleotides for MSP - Taqman analysis of PROSTAGLANDIN E2 RECEPTOR

| SEQ ID NO: | Sequence | Type |
|---|---|---|
| 996 | cgcgctactccgcataca | primer |
| 997 | gaggtaatcgaggcggtcg | primer |
| 998 | /56-FAM/cgccaattcatacgccgcacc/3BHQ_1/ | probe |

PCR Program

| denat at 95° C. | | |
|---|---|---|
| 95° C. | 10 min | |
| 50 cycles: | ramp | |
| denat at 95° C. | 10 sec | (20° C./s) |
| annealing 60C° C. | 45 sec | (20° C./s) detection |

MSP Analysis of the Gene ORPHAN NUCLEAR RECEPTOR NR5A2.

In the following analysis the methylation status of the gene ORPHAN NUCLEAR RECEPTOR NR5A2 was analysed by means of methylation specific amplification using the primers according to Table 16(below).

The sequence of interest is amplified by means of methylation specific primers, the amplificate is then detected by means of methylation specific Taqman probes.

TABLE 16B

Oligonucleotides for MSP - Taqman analysis of ORPHAN NUCLEAR RECEPTOR NR5A2.

| SEQ ID NO: | Sequence | Type |
|---|---|---|
| 999 | ttgtggttcgggaagagac | primer |
| 1000 | tcccgaactcttcgatcg | primer |
| 1001 | aactacgcgcaaaccccgcga | probe |

PCR Program

| denat at 95° C. | | |
|---|---|---|
| 95° C. | 10 min | |
| 50 cycles: | ramp | |
| denat at 95° C. | 10 sec | (20° C./s) |
| annealing 60C° C. | 45 sec | (20° C./s) detection |

Marker Analysis

Results were analyzed qualitatively by scoring amplification as ± and quantitatively by determining the percentage of methylated DNA as a fraction of total DNA calculated using the C3 bisulfite specific PCR. To measure total methylated DNA, a 100% methylated standard (chemicon SSS1 treated DNA) standard curve was included in each assay.

Results

For each marker a Receiver Operating Characteristic curve (ROC curve) of the assay was determined. A ROC is a plot of the true positive rate against the false positive rate for the different possible cutpoints of a diagnostic test. It shows the tradeoff between sensitivity and specificity depending on the selected cutpoint (any increase in sensitivity will be accompanied by a decrease in specificity). The area under an ROC curve (AUC) is a measure for the accuracy of a diagnostic test (the larger the area the better, optimum is 1, a random test would have a ROC-curve lying on the diagonal with an area of 0.5; for reference: J. P. Egan. Signal Detection Theory and ROC Analysis, Academic Press, New York, 1975).

AUC Results:
Serum:
Marker: HeavyMethyl GSTP1
    AUC: 0.51
Marker: MSP HISTONE H4
    AUC: 0.59
Marker: MSP PROSTAGLANDIN E2 RECEPTOR
    AUC: 0.52
Marker: MSP ORPHAN NUCLEAR RECEPTOR NR5A2
    AUC: 0.50
Urine:
Marker: HeavyMethyl GSTP1
    AUC: 0.58
Marker: MSP HISTONE H4
    AUC: 0.5
Marker: MSP PROSTAGLANDIN E2 RECEPTOR
    AUC: 0.49
Marker: MSP ORPHAN NUCLEAR RECEPTOR NR5A2
    AUC: 0.56

To provide an accurate detection of prostate cancer it is preferred that a combined analysis of multiple markers is carried out (i.e. a gene panel). For analysis of urine based samples a preferred combination of markers is GSTP1, PROSTAGLANDIN E2 RECEPTOR & ORPHAN NUCLEAR RECEPTOR NR5A2 with a sensitivity of 0.37 and a specificity of 0.72.

For analysis of serum based samples a most preferred combination of markers is GSTP1, HISTONE H4 & ORPHAN NUCLEAR RECEPTOR NR5A2 with a sensitivity of 0.35 and a specificity of 0.75.

MSP Analysis of the Genes According to Table 18.

In the following analysis the methylation status of a selection of the genes according to Table 18 were analysed by means of MSP TaqMan assays using the primers and probes according to Table 6 (below).

The study was run on 10 samples from prostate carcinoma tissue, 10 from benign prostate hyperplasia tissue and 5 normal tissue samples. Genomic DNA was analyzed using the MSP technique after bisulfite conversion. Total genomic DNA of all samples was bisulfite treated converting unmethylated cytosines to uracil. Methylated cytosines remained conserved. Bisulfite treatment was performed with minor modifications according to the protocol described in Olek et al. (1996).

The sequence of interest was then amplified by means of primers specific for bisulfite treated DNA and the amplificates were detected by means of TaqMan probes using TaqMan and/or Lightcycler platforms. Results are shown in Table 20 below.

Reagents and cycling conditions were as follows:
SEQ ID NO: 20

| Reagent | Final Conc. |
|---|---|
| Forward Primer | 0.5 uM |
| Reverse Primer | 0.5 uM |
| Probe | 0.4 uM |
| MgCl | 2.5 mM |
| FastStart | 1x |
| Water | — |
| Template | — |
| Total | — |

| Temperature (C.) | Time (sec) | Rate (C/sec) | Collect? | # of Cycles |
|---|---|---|---|---|
| Denature | | | | 1 |
| 95 | 600 | 20 | | |
| Annealing | | | | 50 |
| 95 | 10 | 20 | | |
| 60 | 45 | 20 | single | |
| Cool | | | | 1 |
| 40 | 30 | 20 | | |

SEQ ID NO: 36

| Reagent | MM Volume (uL) |
|---|---|
| Forward Primer | 35.0 |
| Reverse Primer | 35.0 |
| Probe | 2.8 |
| Water | 32.2 |
| Taqmix | 245.0 |
| Total | 350.0 |

| Temperature (C.) | Time (sec) | # of Cycles |
|---|---|---|
| Denature | | 1 |
| 95 | 600 | |
| Annealing | | 50 |
| 95 | 10 | |
| 60 | 45 | |

SEQ ID NO: 31

| Reagent | Final Conc. |
|---|---|
| Forward Primer | 0.5 uM |
| Reverse Primer | 0.5 uM |
| Probe | 0.4 uM |
| MgCl | 2.5 mM |
| FastStart | 1x |
| Water | — |
| Template | — |
| Total | — |

| Temperature (C.) | Time (sec) | Rate (C/sec) | Collect ? | # of Cycles |
|---|---|---|---|---|
| Denature | | | | 1 |
| 95 | 600 | 20 | | |
| Annealing | | | | 50 |
| 95 | 10 | 20 | | |
| 60 | 45 | 20 | single | |
| Cool | | | | 1 |
| 40 | 30 | 20 | | |

SEQ ID NO: 11

| Reagent | MM Volume (uL) |
|---|---|
| Forward Primer | 35.0 |
| Reverse Primer | 35.0 |
| Probe | 2.8 |
| Water | 32.2 |
| Taqmix | 245.0 |
| Total | 350.0 |

| Temperature (C.) | Time (sec) | # of Cycles |
|---|---|---|
| Denature | | 1 |
| 95 | 600 | |
| Annealing | | 50 |
| 95 | 10 | |
| 60 | 45 | |

TABLE 19

| Genomic sequence SEQ ID NO: | Forward primer SEQ ID NO: | Reverse primer SEQ ID NO: | Probe SEQ ID NO: |
|---|---|---|---|
| 20 | 1002 | 1003 | 1004 |
| 36 (assay 4) | 1005 | 1006 | 1007 |
| 36 (assay 1) | 1008 | 1009 | 1010 |
| 31 | 1011 | 1012 | 1013 |
| 11 | 1014 | 1015 | 1016 |

TABLE 20

| Genomic sequence SEQ ID NO | Sensitivity (%) | Specificity |
|---|---|---|
| 20 | 70 | 88 |
| 36 (assay 1) | 60 | 94 |
| 31 | 80 | 80 |
| 11 | 80 | 79 |
| 36 (assay 4) | 60 | 98 |

Example 6

Introduction

The GSTPi gene is one of the best characterized methylation prostate diagnostic markers. The aim of the following investigation is to identify methylation markers prostate diagnostic which are able to identify prostate cancers which do not present aberrant GSTPi methylation. It is anticipated that said identified markers would be particularly useful as a member of a gene panel comprising GSTPi for the diagnosis and/or screening of prostate cancers.

Genome wide methylation analysis experiments were carried out to identify differentially methylated sequence candidates among sub-types of prostate cancers, which had different DNA methylation profiles for the GSTP1 gene. The genome wide methylation analysis methods AP-PCR and MCA were utilized in this study. Three comparisons were run using AP-PCR and two comparisons using MCA as described in the experimental plan.

Comparisons were carried out as the protocols as described in Example 1 above.

Experimental Plan

Four (4) Sample Pools were Used for this Study

| Pool # | Sample Nature | Pool Short Name | Sample Size per Pool | Comment |
|---|---|---|---|---|
| 1 | Prostate Cancer GSTP1 positive | GSTP1 (+) | 12 | used for APPCR and MCA |
| 2 | Prostate Cancer GSTP1 negative | GSTP1 (−) | 2 | used for APPCR and MCA |
| 3 | Prostate Cancer GSTP1 negative | GSTP1 (−) | 4 | used for MCA only |
| 4 | Prostate Cancer GSTP1 maybe expressed | GSTP1 (?) | 2 | used for APPCR only |

For AP-PCR, 3 sample pools (Pool #1, 2 & 4) were run together to allow a multi-way comparison. Three comparisons were made: GSTP1(+) vs. GSTP1(−), GSTP1(+) vs. GSTP1(?), and GSTP1(−) vs. GSTP1(?). On the same gel, differentially methylated bands migrating at the same speed were assumed to have the same sequences and were, therefore, only cloned and sequenced once. However, every differentially methylated band was assigned a unique MeST ID.

Two MCA comparisons were performed. Both used the GSTP1 (+) sample pool (Pool #1) as the tester and GSTP1 (−) sample pool (Pool #2 or Pool #3) as driver.

Experimental Results Overview 96 non-redundant differentially methylated sequences were identified
39 out of the 96 was identified by AP-PCR
57 out of the 96 was identified by MCA
61 of the non-redundant differentially methylated sequences scored 0 or greater
None appeared using both methods
Scoring by Method:

| | Score | | | | | |
|---|---|---|---|---|---|---|
| | 0 | 1 | 2 | 3 | 4 | 5 |
| AP-PCR | 0 | 9 | 10 | 10 | 3 | 2 |
| MCA | 2 | 13 | 9 | 1 | 1 | 1 |
| Total | 2 | 22 | 19 | 11 | 4 | 3 |

Interesting Candidate Differentially Methylated Sequences

The 96 differentially methylated sequences were rated using the following parameters:

% repeat—percentage of repeat in 1000 bp flanking region on either 3' or 5' side of differentially methylated sequences;

% CpG island—percentage of CpG island flanking either side of differentially methylated sequences;

Within promoter—differentially methylated sequences is found within 5000 bp upstream of exon 1;

Within gene—differentially methylated sequence is found anywhere between flanking exons Of these SEQ ID Nos. 1017 to 1028 were selected for further analysis, of particular interest was SEQ ID NO: 1023. SEQ ID Nos. 1017 to 1028 were further investigated by means of sensitive assays according to Example 7 below.

Example 7

Introduction

In the following analysis the methylation status of the genes according to Table 21 were analysed by means of methylation specific polymerase chain reaction, using the method and samples as described in Example 4.

The study was run on 50 prostate cancer and 50 Benign Prostate Hyperplasia (BPH) tissue samples. Genomic DNA was analyzed using the MSP technique after bisulfite conversion. The bisulfite process converts unmethylated cytosines to uracil while methylated cytosines remained conserved. Bisulfite treatment was performed with minor modifications according to the protocol described in Olek et al. (1996). Sequences of interest were then amplified by means of methylation specific primers, and the amplificate is detected by means of Taqman probes (see Table 21).

TABLE 21

| Genomic SEQ ID NO: | Forward Primer SEQ ID NO: | Reverse Primer SEQ ID NO: | Probe SEQ ID NO: |
|---|---|---|---|
| 1017 | 1077 | 1078 | 1079 |
| 1024 | 1080 | 1081 | 1082 |
| 1027 | 1083 | 1084 | 1085 |
| 1018 | 1086 | 1087 | 1088 |
| 1019 | 1089 | 1090 | 1091 |
| 1021 | 1092 | 1093 | 1094 |
| 1023 | 1095 | 1096 | 1097 |
| 1023 | 1098 | 1099 | 1100 |
| 1025 | 1101 | 1102 | 1103 |
| 1028 | 1104 | 1105 | 1106 |
| 1026 | 1107 | 1108 | 1109 |
| 1020 | 1110 | 1111 | 1112 |
| 1116 | 1113 | 1114 | 1115 |
| 18 | 1179 | 1180 | 1181 |

Results:

Statistical methods used are as described above in Example 4.

TABLE 24

Sensitivity and specificity of MSP assays

| Gene | ROC AUC | SVM Acc | SVM Sens | SVM Spec |
|---|---|---|---|---|
| SEQ ID NO: 1023 | 0.953 | 0.898 | 0.888 | 0.908 |
| RASSF1a.Nelson | 0.903 | 0.828 | 0.800 | 0.857 |
| SEQ ID NO: 1028 | 0.809 | 0.762 | 0.742 | 0.783 |
| SEQ ID NO: 1113 | 0.629 | 0.561 | 0.527 | 0.597 |
| SEQ ID NO: 1025 | 0.579 | 0.561 | 0.240 | 0.896 |
| SEQ ID NO: 1020 | 0.561 | 0.567 | 0.599 | 0.534 |
| SEQ ID NO: 1019 | 0.532 | 0.527 | 0.869 | 0.171 |

TABLE 24-continued

Sensitivity and specificity of MSP assays

| Gene | ROC AUC | SVM Acc | SVM Sens | SVM Spec |
|---|---|---|---|---|
| SEQ ID NO: 1027 | 0.512 | 0.499 | 0.895 | 0.088 |
| SEQ ID NO: 18 | 0.533 | 0.491 | 0.803 | 0.167 |

Example 8

Panels

The best performing markers in terms of assay based performance as deduced from Examples 1 to 7 above are shown in Table 25.

In order to optimise the performance of markers in the detection of prostate cancer MSP assays of markers according to Examples 4 and 7 above were combined in gene panels of 2 and 3. Tables 22 to 24 below illustrate the sensitivity and specificity of said combinations of MSP assayed markers in the detection of prostate cancer.

TABLE 22

Sensitivity and specificity of Prostate cancer using MSP assays of 2 markers.

| Marker 1 | Marker 2 | Sensitivity | Specificity |
|---|---|---|---|
| SEQ ID NO: 1023 | SEQ ID NO: 57 | 0.860 | 0.967 |
| SEQ ID NO: 1023 | SEQ ID NO: 20 | 0.864 | 0.948 |
| SEQ ID NO: 1023 | SEQ ID NO: 4 | 0.864 | 0.935 |
| SEQ ID NO: 1028 | SEQ ID NO: 1023 | 0.860 | 0.938 |
| SEQ ID NO: 1116 | SEQ ID NO: 1023 | 0.860 | 0.938 |
| SEQ ID NO: 1027 | SEQ ID NO: 1023 | 0.860 | 0.938 |
| SEQ ID NO: 1019 | SEQ ID NO: 1023 | 0.860 | 0.938 |
| SEQ ID NO: 1020 | SEQ ID NO: 1023 | 0.860 | 0.938 |
| SEQ ID NO: 1023 | SEQ ID NO: 1025 | 0.860 | 0.938 |
| SEQ ID NO: 1023 | SEQ ID NO: 11 | 0.860 | 0.938 |
| SEQ ID NO: 1023 | SEQ ID NO: 24 | 0.860 | 0.938 |
| SEQ ID NO: 1023 | SEQ ID NO: 18 | 0.860 | 0.938 |
| SEQ ID NO: 1023 | SEQ ID NO: 31 | 0.864 | 0.933 |
| SEQ ID NO: 1023 | SEQ ID NO: 35 | 0.880 | 0.917 |
| SEQ ID NO: 20 | SEQ ID NO: 57 | 0.812 | 0.978 |

TABLE 23

Sensitivity and specificity of Prostate cancer using MSP assays of 3 markers.

| Marker 1 | Marker 2 | Marker 3 | Sensitivity | Specificity |
|---|---|---|---|---|
| SEQ ID NO: 1023 | SEQ ID NO: 18 | SEQ ID NO: 57 | 0.86 | 0.97916667 |
| SEQ ID NO: 1023 | SEQ ID NO: 4 | SEQ ID NO: 57 | 0.86 | 0.97826087 |
| SEQ ID NO: 1116 | SEQ ID NO: 1023 | SEQ ID NO: 57 | 0.86 | 0.975 |

TABLE 23-continued

Sensitivity and specificity of Prostate cancer using MSP assays of 3 markers.

| Marker 1 | Marker 2 | Marker 3 | Sensitivity | Specificity |
|---|---|---|---|---|
| SEQ ID NO: 1020 | SEQ ID NO: 1023 | SEQ ID NO: 57 | 0.864 | 0.97083333 |
| SEQ ID NO: 1028 | SEQ ID NO: 1023 | SEQ ID NO: 57 | 0.86 | 0.97083333 |
| SEQ ID NO: 1027 | SEQ ID NO: 1023 | SEQ ID NO: 57 | 0.864 | 0.96666667 |
| SEQ ID NO: 1023 | SEQ ID NO: 57 | RASSF1a | 0.86 | 0.97021277 |
| SEQ ID NO: 1019 | SEQ ID NO: 1023 | SEQ ID NO: 57 | 0.86 | 0.96666667 |
| SEQ ID NO: 1023 | SEQ ID NO: 31 | SEQ ID NO: 57 | 0.864 | 0.9625 |
| SEQ ID NO: 1019 | SEQ ID NO: 1023 | SEQ ID NO: 20 | 0.868 | 0.95652174 |
| SEQ ID NO: 1023 | SEQ ID NO: 20 | SEQ ID NO: 4 | 0.88 | 0.94347826 |
| SEQ ID NO: 1023 | SEQ ID NO: 1025 | SEQ ID NO: 57 | 0.852 | 0.97083333 |
| SEQ ID NO: 1023 | SEQ ID NO: 51 | SEQ ID NO: 57 | 0.86 | 0.9625 |
| SEQ ID NO: 1023 | SEQ ID NO: 20 | SEQ ID NO: 57 | 0.86 | 0.96086957 |
| SEQ ID NO: 1020 | SEQ ID NO: 1023 | SEQ ID NO: 20 | 0.868 | 0.95217391 |

Example 9

In order to provide an alternative assay format to the MSP assays as described above, further HeavyMethyl assays were established. The primers and blockers of said assays are shown in Table 24.

TABLE 24

HeavyMethyl Assay Components

| Marker | Primer SEQ ID NO: | Primer SEQ ID NO: | Blocker SEQ ID NO: | Probe SEQ ID NO: | Probe SEQ ID NO: |
|---|---|---|---|---|---|
| GSTP1 (assay 1) | 1121 | 1122 | 1123 | 1124 | 1125 |
| GSTP1 (assay 2) | 1126 | 1127 | 1128 | 1129 | 1130 |
| GSTP1 (assay 3) | 1131 | 1132 | 1133 | 1134 | 1135 |
| GSTP1 (assay 4) | 1136 | 1137 | 1138 | 1139 | 1140 |
| SEQ ID NO: 20 (assay 1) | 1141 | 1142 | 1143 | 1144 | 1145 |
| SEQ ID NO: 20 (assay 2) | 1146 | 1147 | 1148 | 1149 | 1150 |
| SEQ ID NO: 24 (assay 1) | 1151 | 1152 | 1153 | 1154 | 1155 |
| SEQ ID NO: 24 (assay 2) | 1156 | 1157 | 1158 | 1159 | 1160 |
| SEQ ID NO: 24 (assay 3) | 1161 | 1162 | 1163 | 1164 | 1165 |
| SEQ ID NO: 36 (assay 1) | 1166 | 1167 | 1168 | 1169 | 1170 |

GSTP1 LightCycler Program:

| activation: | 95° C. | 10 min | |
|---|---|---|---|
| 50 cycles: | 95° C. | 10 sec (20° C./s) | |
| | 56° C. | 30 sec (20° C./s) | |
| | 72° C. | 10 sec (20° C./s) | detection |
| melting curve: | 95° C. | 10 sec | 20 |
| | 40° C. | 10 sec | 20 |
| | 70° C. | 0 sec | 0.1 |
| cooling: | 40° C. | 5 sec | |

SEQ ID NO: 20, SEQ ID NO: 24 & SEQ ID NO: 36 LightCycler Program:

| activation: | 95° C. | 10 min | |
|---|---|---|---|
| 55 cycles: | 95° C. | 10 sec (20° C./s) | |
| | 56° C. | 30 sec (20° C./s) | |
| | 72° C. | 10 sec (20° C./s) | |
| melting | 95° C. | 10 sec | 20 |
| | 35° C. | 20 sec | 20 detection |
| | 95° C. | 0 sec | 0.1 |

TABLE 25

| Marker | ROC AUC | AUC St Err | SVM Acc | SVM Sens | SVM Spec |
|---|---|---|---|---|---|
| SEQ ID NO: 1023 | 0.953 | 0.000 | 0.898 | 0.888 | 0.908 |
| GSTP1 | 0.932 | 0.001 | 0.928 | 0.892 | 0.965 |
| PROSTAGLANDIN E2 RECEPTOR | 0.921 | 0.001 | 0.849 | 0.829 | 0.871 |
| HISTONE H4 | 0.918 | 0.001 | 0.801 | 0.880 | 0.719 |
| RASSF1A | 0.903 | 0.001 | 0.828 | 0.800 | 0.857 |
| PR-DOMAIN ZINC FINGER PROTEIN 16 | 0.871 | 0.001 | 0.794 | 0.768 | 0.822 |
| LIM DOMAIN KINASE 1 | 0.868 | 0.001 | 0.773 | 0.791 | 0.755 |
| ORPHAN NUCLEAR RECEPTOR NR5A2 | 0.859 | 0.001 | 0.784 | 0.694 | 0.878 |
| SEQ ID NO: 11 | 0.842 | 0.002 | 0.761 | 0.815 | 0.704 |
| SEQ ID NO: 1028 | 0.809 | 0.002 | 0.762 | 0.742 | 0.783 |
| LIM/HOMEOBOX PROTEIN LHX9 | 0.745 | 0.003 | 0.675 | 0.695 | 0.653 |
| SEQ ID NO: 1116 | 0.629 | 0.003 | 0.561 | 0.527 | 0.597 |
| SEQ ID NO: 1025 | 0.579 | 0.001 | 0.561 | 0.240 | 0.896 |
| SEQ ID NO: 1020 | 0.561 | 0.003 | 0.567 | 0.599 | 0.534 |
| LYSOSOMAL-ASSOCIATED MULTITRANSMEMBRANE PROTEIN | 0.533 | 0.004 | 0.491 | 0.803 | 0.167 |
| SEQ ID NO: 1019 | 0.532 | 0.004 | 0.527 | 0.869 | 0.171 |
| SEQ ID NO: 1027 | 0.512 | 0.001 | 0.499 | 0.895 | 0.088 |

TABLE 26

Genes and sequences according to present invention

| Gene ref seq ID: | Genomic SEQ ID NO: | Sense methylated converted SEQ ID NO: | Antisense methylated converted SEQ ID NO: | Sense unmethylated converted SEQ ID NO: | Antisense unmethylated converted SEQ ID NO: |
|---|---|---|---|---|---|
| genomic sequence | 1 | 60 | 61 | 178 | 179 |
| genomic sequence | 2 | 62 | 63 | 180 | 181 |
| genomic sequence | 3 | 64 | 65 | 182 | 183 |
| NM_014242 | 4 | 66 | 67 | 184 | 185 |
| genomic sequence | 5 | 68 | 69 | 186 | 187 |
| genomic sequence | 6 | 70 | 71 | 188 | 189 |
| genomic sequence | 7 | 72 | 73 | 190 | 191 |
| NM_003352 | 8 | 74 | 75 | 192 | 193 |
| NM_003458 | 9 | 76 | 77 | 194 | 195 |
| genomic sequence | 10 | 78 | 79 | 196 | 197 |
| genomic sequence | 11 | 80 | 81 | 198 | 199 |
| genomic sequence | 12 | 82 | 83 | 200 | 201 |
| NM_013312 | 13 | 84 | 85 | 202 | 203 |
| genomic sequence | 14 | 86 | 87 | 204 | 205 |
| genomic sequence | 15 | 88 | 89 | 206 | 207 |
| genomic sequence | 16 | 90 | 91 | 208 | 209 |
| genomic sequence | 17 | 92 | 93 | 210 | 211 |
| NM_006762 | 18 | 94 | 95 | 212 | 213 |
| NM_005539 | 19 | 96 | 97 | 214 | 215 |
| NM_000958 | 20 | 98 | 99 | 216 | 217 |
| genomic sequence | 21 | 100 | 101 | 218 | 219 |
| genomic sequence | 22 | 102 | 103 | 220 | 221 |
| NM_004955 | 23 | 104 | 105 | 222 | 223 |
| NM_003822 | 24 | 106 | 107 | 224 | 225 |
| NM_032526 | 25 | 108 | 109 | 226 | 227 |
| genomic sequence | 26 | 110 | 111 | 228 | 229 |
| genomic sequence | 27 | 112 | 113 | 230 | 231 |
| genomic sequence | 28 | 114 | 115 | 232 | 233 |
| NM_004565 | 29 | 116 | 117 | 234 | 235 |
| NM_156037 | 30 | 118 | 119 | 236 | 237 |
| NM_002314 | 31 | 120 | 121 | 238 | 239 |
| NM_021642 | 32 | 122 | 123 | 240 | 241 |
| NM_020132 | 33 | 124 | 125 | 242 | 243 |
| NM_133267 | 34 | 126 | 127 | 244 | 245 |
| genomic sequence | 35 | 128 | 129 | 246 | 247 |
| NM_003495 | 36 | 130 | 131 | 248 | 249 |
| NM_004518 | 37 | 132 | 133 | 250 | 251 |
| NM_003916 | 38 | 134 | 135 | 252 | 253 |
| genomic sequence | 39 | 136 | 137 | 254 | 255 |
| genomic sequence | 40 | 138 | 139 | 256 | 257 |
| NM_002705 | 41 | 140 | 141 | 258 | 259 |
| genomic sequence | 42 | 142 | 143 | 260 | 261 |
| genomic sequence | 43 | 144 | 145 | 262 | 263 |
| genomic sequence | 44 | 146 | 147 | 264 | 265 |
| genomic sequence | 45 | 148 | 149 | 266 | 267 |
| genomic sequence | 46 | 150 | 151 | 268 | 269 |
| genomic sequence | 47 | 152 | 153 | 270 | 271 |

TABLE 26-continued

Genes and sequences according to present invention

| Gene ref seq ID: | Genomic SEQ ID NO: | Sense methylated converted SEQ ID NO: | Antisense methylated converted SEQ ID NO: | Sense unmethylated converted SEQ ID NO: | Antisense unmethylated converted SEQ ID NO: |
|---|---|---|---|---|---|
| genomic sequence | 48 | 154 | 155 | 272 | 273 |
| genomic sequence | 49 | 156 | 157 | 274 | 275 |
| NM_030928 | 50 | 158 | 159 | 276 | 277 |
| NM_022114 | 51 | 160 | 161 | 278 | 279 |
| NM_002555 | 52 | 162 | 163 | 280 | 281 |
| NM_000044 | 53 | 164 | 165 | 282 | 283 |
| NM_004360 | 54 | 166 | 167 | 284 | 285 |
| NM_000077 | 55 | 168 | 169 | 286 | 287 |
| NM_000610 | 56 | 170 | 171 | 288 | 289 |
| NM_000852 | 57 | 172 | 173 | 290 | 291 |
| NM_000612 | 58 | 174 | 175 | 292 | 293 |
| NM_080552 | 59 | 176 | 177 | 294 | 295 |
| genomic sequence | 1017 | 1029 | 1030 | 1053 | 1054 |
| genomic sequence | 1018 | 1031 | 1032 | 1055 | 1056 |
| genomic sequence | 1019 | 1032 | 1034 | 1057 | 1058 |
| genomic sequence | 1020 | 1033 | 1036 | 1059 | 1060 |
| genomic sequence | 1021 | 1034 | 1038 | 1061 | 1062 |
| genomic sequence | 1022 | 1035 | 1040 | 1063 | 1064 |
| genomic sequence | 1023 | 1036 | 1042 | 1065 | 1066 |
| genomic sequence | 1024 | 1037 | 1044 | 1067 | 1068 |
| genomic sequence | 1025 | 1038 | 1046 | 1069 | 1070 |
| genomic sequence | 1026 | 1039 | 1048 | 1071 | 1072 |
| genomic sequence | 1027 | 1040 | 1050 | 1073 | 1074 |
| genomic sequence | 1028 | 1041 | 1052 | 1075 | 1076 |
| Genomic sequence | 1116 | 1117 | 1118 | 1119 | 1120 |
| AF102770 | 1171 | 1172 | 1173 | 1174 | 1175 |

Names of genes according to Table 26, wherein the table specifies "Genomic sequence" there is currently no gene mapped to the given sequence.

NM_014242:LIM/HOMEOBOX PROTEIN LHX9

NM_003352:UBIQUITIN-LIKE PROTEIN SMT3C PRECURSOR (UBIQUITIN-HOMOLOGY DOMAIN PROTEIN PIC1) (IBIQUITIN-LIKE PROTEIN UBL1) (UBIQUITIN-RELATED PROTEIN SUMO-1) (GAP MODIFYING PROTEIN 1) (GMP1) (SENTRIN)

NM_003458:"BASSOON; ZINC FINGER PROTEIN 231; NEURONAL DOUBLE ZINC FINGER PROTEIN"

NM_013312:HOOK2 PROTEIN

NM_006762:LYSOSOMAL-ASSOCIATED MULTI-TRANSMEMBRANE PROTEIN (RETINOIC ACID—INDUCIBLE E3 PROTEIN) (HA1520) LAM5

NM_005539:"TYPE I INOSITOL-1,4,5-TRISPHOSPHATE 5-PHOSPHATASE (EC 3.1.3.56) (5PTASE)"

NM_000958:PROSTAGLANDIN E2 RECEPTOR, EP4 SUBTYPE (PROSTANOID EP4 RECEPTOR) (PGE RECEPTOR, EP4 SUBTYPE)

NM_004955:EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE

NM_003822:ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HBIF) (CYP7A PROMOTER BINDING FACTOR)

NM_032526:PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)

NM_004565:PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)

NM_156037:HOMEOBOX PROTEIN HOX-B6 (HOX-2B) (HOX-2.2)

NM_002314:LIM DOMAIN KINASE 1 (EC 2.7.1.37) (LIMK-1)

NM_021642:LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)

NM_020132:1-ACYL-SN-GLYCEROL-3-PHOSPHATE ACYLTRANSFERASE GAMMA (EC 2.3.1.51) (1-AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O-ACYLTRANSFERASE 3)

NM_133267:HOMEOBOX PROTEIN GSH-2

NM_003495:HISTONE H4

NM_004518:POTASSIUM VOLTAGE-GATED CHANNEL SUBFAMILY KQT MEMBER 2 (NEUROBLASTOMA-SPECIFIC POTASSIUM CHANNEL KQT-LIKE 2)

NM_003916:ADAPTER-RELATED PROTEIN COMPLEX 1 SIGMA 1B SUBUNIT (SIGMA-ADAPTIN 1B) (ADAPTOR PROTEIN COMPLEX AP-1 SIGMA-1B SUBUNIT) (GOLGI ADAPTOR HA1/AP1 ADAPTIN SIGMA-1B SUBUNIT) (CLATHRIN ASSEMBLY PROTEIN COMPLEX 1 SIGMA-1B SMALL CHAIN) (SIGMA 1B SUBUNIT OF AP-1 CLATHRIN) (DC22)

NM_002705:PERIPLAKIN (195 KDA CORNIFIED ENVELOPE PRECURSOR) (190 KDA PARANEOPLASTIC PEMPHIGUS ANTIGEN)

NM_030928:"DNA REPLICATION FACTOR; DOUBLE PARKED, *DROSOPHILA*, HOMOLOG OF"

NM_022114:PR-DOMAIN ZINC FINGER PROTEIN 16 (TRANSCRIPTION FACTOR MEL1)
NM_002555:"TUMOR SUPPRESSING SUBTRANSFERABLE CANDIDATE 5; P45 BECKWITH-WIEDEMANN REGION 1A; BECKWITH-WIEDEMANN SYNDROME CHROMOSOME REGION 1, CANDIDATE A; EFFLUX TRANSPORTER-LIKE PROTEIN; ORGANIC CATION TRANSPORTER-LIKE 2; TUMOR-SUPPRESSING STF CDNA 5; IMPRINTED MULTI-MEMBRANE SPANNING POLYSPECIFIC TRANSPORTER-RELATED PROTEIN"
NM_000044:AR
NM_004360:CDH1
NM_000077:CDKN2a
NM_000610:CD44
NM_000852:GSTP1
NM_000612:IGF2
NM_080552:VIAAT
AF102770:RASSF1A

SEQUENCE LISTING (1181 sequences)

SEQ ID NO: 1 - DNA, 2299 bp, Homo Sapiens
gttggccatggggcctcgaccctgaccacaaggccagggacccgcctgggattagtggacagatgcttttagcaaagccaccagggctccaggggccagacaggaaacctccctccctccctccctccctgtggcttccctgcccccaccaagacagcccccaggacctgggggacagccagcctgaggtctcttcccaaacgaaagaagtccagcctggcctttaggaagtgtgtggacatccttggagttgctgctccctggagtgggtctgtgatttcagagtcccatgcttccagtgctgggatggggaggtctggggagccaggctaggtgggggtagctcttacctgggggggcacagcaggcagcgccagcccggccaggagctgcaggaagcaagggaacagcctcatgaccggcatcttctcagacgtcccgagccagggggctccgagggaaaaccaccatgctcatcccccggggagcccctggcacaggaggagaagagctgagtggggggctggacgcctccctcactgctgccccgaggccccggccggtggttcgagcatcttctggaagccttgcggagtcaggagcccgtaggtaaggctgtggctggggaacccgacggggagcggcccggcggggcggggcgccgaggggcaggcgggtcccggggatggtccgtcgggcgcccagtgccactccaggtcctcccgtagctgggcggccgtccgtcgatgcagtttcctccgcagacagcagctcccttctgagactgcagccggtccgcgcctgggtttcagggactgagccggggcggggctccgggccggccccgcccaccgcagacgaggttcccgagccgagttcccggagcgcccggtcagcccgcagcgcccggccagcccgcagcgccggagcccgcagtgcgtgcgaggggctctcggcaggtccagacgcctcgccgagcccagcccgcagctccccgggccgcgccgcgcccgcccacagggcccacagccctgcttcggctctcagggcggtcacctgggatgggggcatccaggagtccagcgtcagccgtcaaggctcatgatctaaccgcctctgcaggaagggccgtccgggatgcctgggaaggcagccatgcccacacccctagggggccaagggattcctagccaggttatatagatgaagaaaccgaggctccgagagcacccctgcctgcatatgtcgaatggacataggcattcttggaaagtgtgtgtgtgttgtgtgtgtgcgcgcatctgtgtgtccgaggaactggcagagacaaaacccaagcctacgtgactccagaactctaacccgacctaccaccctcctagccaggcacggacacagtgggcctcccacaggaaacctctcagggcacctggctggaggatcaggcctgttgcctccttgggaagcagtcttcccaggccctccctgcggggcagccccctgtggtagagagtggtctcactcaggcatctcctcctggtccctggccgaggaggaactgtacgctgcgcgggggtctgtgtgcatctgcgcgtgtgcatgggcatttgcgggtctgtgaatatccatgagcggtgcatctgagcctctgtgtggtctgagtacgtgtgactactgtacctccaaatacgcctctgtgtgggggtcaggtctctctgtatctctgtatgcttgtgtgatctgttcgtgtccgctgtgtatctgggtgtgtttggaagtgtctgaatgtgtatctttcggtgggactgtgagtctgcacgcctgcctgtctctgcgtgtgtgtgtctgtctctgtgggtgaagactgtgcctctctctctgcgtttgtgtgtgccctcccttggttctggatctttctttaccaccactcctctcactgccttctgtgtccagctcccaggctgcaggaacctggcaggactgggagtcacgagttggctgggcctggggctggtgggtggctgtgggggaggagcgaggcctgggaagtggcccctacagctcacattccagccaagagcagggaggccagggcagccccagctctcaccccagtgacctctgcgtccactgcctgcctgcctgcccacccacgaggggctgccagagatgcagcctgcctgcctggccggccctaagcctggaggttcaggaggcgggggccagtcaccagctggctaagcggggtctgcaaggaacatcctgacgagcttcaaacaagctggggttcgtggggtag

SEQ ID NO: 2 - DNA, 2428 bp, Homo Sapiens
acagcgatttgagaaagctgtccttaagttttctcttctccttgactgtatgacattatttttacaattatacttccaaagtttgctctttccaaacaccacaagacctatgtaatttaagcagtgattttaggggtctctgtatattttatattaatttcagaaacatgctcatgattattccaccaaaactatcaactgttacataaacatctgtccttctatgagttgcaaaataattgtcaccatccccacttaatcaaccatcttgtatccttctttgaccaacttctgaaaaataacacccaatactaaaggcatctccttctattcagggtctcagacagtaagacgttctttccttaaacagtaagacgttttctcaagtcccatggaaagcacttctttgatatcagtttggggaggccgaactctggagtcttcatccgaagagtaaagtaccgcactcagtaatgcgcgtcctgggaaccaagcctaagcagttttggccgcttcctcgtccaggctggcattgtctgtgttcgccagcccctccgcgaagttagctcatttgcggatcaggccaaatccctggagacttcacgcagacgcgggtgcagcctgctctgggacttgaagtccgctggagcctgagcctctgcatcatccgggtggagctctctctgctgctgccaaaggatcccgcctggatgctcatcccgccaccgtcgcccaccccgcagctgcagaatggcagcaactgccacacacctaagcaacttggctggctattcgccctgcagctcccgccagcgcgctgcccaagctggcaatcaaaagtctgggaaagcgcgaaagcgccacgtgcctcgcactccgcccagctgccgcgcagctcctccctggcttccactgggagacaggggactcccatgagaaggaaggagcagggcagtgattgcttagtttatcctgggacgcgggagctgtccccgtggactgagtggcgcggagaggggatcactgagaccgggaagggtcatccagacaaataaggaggggtgcgggtgggcgcgcagtgccctccgcccggccttcagacccacccgcgcgcgcgcaggcgtgtgctctcatccttcccttcccttcactgtctggagtgatgataattggcttccaaagtggatgagagatgagtcatttacatccaatgagggaaaaacagcctccagagactcttcgtccattggccagtgagagtgtcaattcccaggctcctgccgcacgcgggcgagcccttctaggcgggaaaagttcagctgagagatataagagagcagactttccagcacctgtgaatccagagcggtgggcactgacgggcacgtgcaccgtgtggacagactctccagttctatgagtggtttttcttttcccgggtcggacctggagttcttaagaggatggctgacaagggcagtaggcagaaggacctcagcccaaagtcaaggaggttttggatggggagctgggcagccgcccgttgtaattcccttcccgtctcagcttcaaaggccaagagttgtactcctgaaaagatacttggagatcatctgggtgttcctgaatctcaagagggtcgtttgaccctggtgggtcctttccctacccggtgcctttctcgcccgtagaaggagaccaggttcggttaagcagagcagaaactattcactgatcaaggaatggagtaggagagctcctgctcaaagtgcctggggtgtagtgtgggggtgctccttaaggtcttttagggcacgtagttggaaagcaaggattcctggaaagagatggggctttccagaaccagctgagtgtggcagtctcctatttgctgttgccgcccaacactacatgtgcctagcaagctgcatttctcccgtaggcacagattgaggtatggtaattagcaattgaggattcaggttagggtagcgcttctaagttcgtttcccatcttgtagcacggtggttactgacatccagtctctgtttctgtaagcaagcacagcttcaagcacaggttaccttaattggttctggggctttaggaaagcattgaggtcatcctgcggtgacagaggcagctgttcaaagaacttggtgcgagtttgaggcaggggttgtggagtgaggcaggtaaaaatgcagattccatagccacaccccgacatactgaatcagagtctgtgagggtgggatctggaatcctttttaaaaagctcagaggaaccaattcacacgaacaataaaagtttcatctgagccaaagaccttaatctagaaatgagaaaacggggatccccaaaagggttacagggagagggttggaggaaagttagactatgacagttttagggtggttctttcc

SEQ ID NO: 3 - DNA, 2485 bp, Homo Sapiens
tttttgccgcctcctttcttcaactcagaacccactaaagacagccaaatatgctacctaccccaaaccaatcacctaagagacactacttttgttagcccacctccagctttcccatgctaataccctcaagtcagagtatacatgaaaccttccctttttgttcactactaagctttcctggccaggtgcagctgctcatccctgtaatcccagcactttgggaggctgagacaggaagactgcttgagcccaggagttcaagaccagcctggacaacatagtgagactccatctctacaaagaattaaaaaaaaataagctgggcatggtggcacgtgcctgtagagccagctactcaggaggttgaggtgggaggatcgcttgctcaggaggtcgaggctgcagtgaaccacgatcgcaccactgcactccagcctggatgacaacagagtgagaccctgtaggtaattaagtaagtaagtagttttcctaatgtcctgacaggctttgagtcggccaaatgcaagtgatggtgactgactcccttgtcatagtaagctttgaataaataaagcatttgggtggtcttcctccccgatcccccccattcattcatttgcttattaattatacattagttgtgttttatctgccaggcagtggccagtattgggaatatgtggaagcaaatagtccctgccttcaaggatattctgtctagtgggacagacagacagacatatacgtataatagtaattcaacgtgctaagtgaaacaataggcatgtataaaaaaggtgtagtaggtcaagtagggcttttaggggaaggcgacccttaagatgggtggtaagggatgagtaggaggtgatttggctaagaggctgggacggttattcaaggcaggtggaggggcagaatgagcaaaacaggacgcgttgctggagcgtggtaaggaaggcaagtagcggcagaggacggcggtagggcggatcgtggggcgcaatggatgtgccacgttggaaagagcttggactttatgccgtcctcctggaaatgagataacggctggtgtaagcaagaaagaaacacacacacacccacgcgcgcgcgtcgtttcctttgtgttactgtaaggtcaaggagggcggcgacacagaaattcatgatgactggcataagcagacattcaatgaatgaatgaatggacataagcactttggtgtaaacgtcattgtcttcgatttctgttttctcacggggcaagacagtgaggtcggggcatcagtttgggaggtgatagggaaggtttaaggtgagagaactgccattctggtagggagggtcagtgggcacaaaaccaacaataggttatgggcaagggatgcgcttcggtcgcgaacaccctgaacccacctaccggagctactctgtcccaggagcggccgtggagaaagcaaccagccgagagttcgcgccccagggagggaagcgggcacagggccgcccagcgccactcacctgtgagctctccgcgggccctgcaggcggagcctcggtacgacgcctttccgattgggcgcggctcaaagtcccggggcgggcatcagaggccgagcgctctaggggattggccaccctggcggacggacgtgctgctgaccgagctggttcgcccccggttcggctcgtggagagccggcccctccgtgagtcttctgtcagtcattggctccctgcggtttccttggggacgtggcgccgccgccggccgggccctccttccggctgggcaaggggccgcggggagcagctcgggactgaaccgagaggtgccgaaggaaccggcgggccgcttgatcccgtgagtgtgggcgcgagagggctgtgggacccggagggacggggagaggaagcgggacccacaccccgccacctggggacgaccggttcctagaggacagagctggcccacgagaacgccccgctcccaggatgcccgggtagggtcccctgggcctgaggaaccagagcagacggagcgggagcctggggaggaggtgggagccgtggaattcccgtgcaggtttgtctcgtgggctcagtcggacagaagcctgaaatcaaatctttctaggctgcagacgtaggagatgcctgggacaaggaggccaccttctcagggcaaaagaaaaagaaggtgacaggcgttgagaccaccgaagggaacccatggctaggtaaggctgcacactttccctccggctgggagcacggcagaggatggcaggcaggttggggggccctgggaggctgtcccaagtgaggtttgccctggagctgcacttggactttgtattctggttagttggatgcagagacgatcaaagttgtattatttcgagggctgataaataatagtttctagcccatagaccaggagtggtagagtgagtcggcttgctcagctctgtaaagtgca

SEQ ID NO: 4 - DNA, 2528 bp, Homo Sapiens
ggtctgactcccggcttttctctgccagtgcaaccaccattacggcgtgatccactccttttcctctaagaatgctgaacggtaccactctagaggcaggtgagttatgtgccaggttccttctgatgttctctgccccttgggccagtgcgtataccatgtgagtgtgtgtgcgtgtgtgtgcgccttcgttgggtggaacgaagaggagtgtgtgtttgtcttaaaaattaaaccgcgcttcgtaggctcaaaaatacacattctctttcagagtctcctgataggactcctgaaaccctccttttgcctttctctttgactgtctttgactttcctcaggatcagtgtccggggcgccaggcagaggtcctggttccactgatcctccagtagtcagtggctccagggacgcgctcctgaccctccggggagctgctgggggtgtctctttcttggaagggatggaaggggggccgagaagacactgtttctcacacgtgtaggggttaactggaaactggcttcacccacatttttttgttgttgttcagtcctaacccagcgcagccgtttctgcgcctgatctcagcggacgcagtgcgggacttctccctttatttctgcagagctgagggcaggcggcgcaacaaatctcaggtaaaagagcatcagatttcagaagagctgtattctagacttggcgcaggcccctttggggagaagagcccaggggctatagagaacagaggtttgaaggaagcaaaagctggcgagaggttttttttttgtcgcgaagggtgagggtaggcagagaacgcgcgaaagggcagggccttggccgggaagtaccgcccagcgaaaggctggcaagggtgcgcagctggagcgtggcctcgggtacccctttccaggcagccgaactccccgtatcccagctctgcttggctgactcccatttgtcttgagggaggatcccctagtaggactgaatcagaagtgcgcccgtgcagcagccccagtatggatctgccaacctcagtgtagggggaaattttccacatggagtatctcagtctccactgtctggagaaaggccccagcgtgtcccggcaatccgctcaccttccatccagcgcagcccgggcatccagggccaggtggcgcggcactgaacgcatggttcccagcctcaggctgacgctgacgtttcactgggccttgggtgctcaggacagtgccagacgctggatactgttttaagagccgcgcctttcaaaccgaaggggctccttaaccagcttaacagggtctggaggaaaggtaacgcctccttcttaaagggcaaacttagaggcgcagaatcatggcctccaaaattcaggtagagagagaccttaagtcacctttgctctcaaaatatgcacatttgttgggttacttcttccctctcaaccctaactgttctgtgggtttaatttccctttcctcccccctagggaattctactgggctcgggttctttgcccatgtagacccacctgagccggcgacaagggcgctgcagtctttttgaccttcatagagattctaagatcccgaactctcagttccaactattatgctccactatagtccggccgtccactttcctaaaagcggcaacagtagcgggatgggtgctgtcagaatagaaaggaaagaaagcttagtggactgcgtgtgctcaattgtgagggagagcagtgctggtcaagggacctgccccattatacctggtagaactttgaatttagaggagacttaagatcttatccccgacgcaggctagagagaaccacatgcacctgtccctcagctcaggaactgaaaaaatgaacactgtaatttttatggaacacttgcgggccattcagactacagctgggagaagggggaacatttttttttttgtccccagccaccgggcctcagcccctctgctggagaggtgaaagaaagcagaggtacaaagatgctttccttatttaaagtgcttatttaaagtcctttgagaatgaggagcggggagctcttaggcaatctttcttgggggctccaagacaaaaagagtagaaaacccagggtcacacacccaattcgagggcattccttcccacccttcctgggcttcctccttaggaactgtgagagaaggcagggctggacccatggggacgtatttccgcagagctaacaaggacctcccaaactccagctgacccccaccccacccccagctttctccagacttcctgcgttcactgagaaggaagaatcctggcagtttgcttctttacaggaagtagcaaatgccactggatgcaggaacttataacctgagttttataagagcaggaatagctaggattcaacttggaaactgattgcagaaggtgttctgccttgcctgtacctagatgattaacaaacttgtgtggaatagaagaatgaatggatgattggagggcttacaaaacctctgtgtt

SEQ ID NO: 5 - DNA, 2321 bp, Homo Sapiens
ccagtcaattattggaaaggatttagtgagtctggtttattttagcttcaatctgggtttgtacacaagcaaaaagcaaatgttgaattttcaggtagaccttcatgcagacatgcaaaaccaactgtctcggtggtgaggagccatggggagctctccgaagggctttccaggcagtgggctaatgggcaaaatgactactcagtggccctgctgaccgatggtacggatgtgccaaggatatctatcagcccatctgagaatatgaaacaaagtgctgagattctactacctaaagtaacaaagaaaccgtaagcaacacgactgacagccagaagggaacactggagttgtggcgtgtaatgctgtcctggattagcacccccaaatctcgccaagccaaaggccttgcccatctgtgagttttccacatgtacagaaccaggcgtggttacgcaaagtctttggacacggcctccacgaagttgggagccgacatcaggatgccgatggtgcagatgatggtgaagaccgagaaggccatgaggcacaggcggtccaccacacaggcggcgaacttccactcgctgcagaccgcctcgctttcgtcctggcagcggaagcggttggcaatgtagcggacctcctccaggatcttggccaagtccgggtccccctcggggggttgcccgccgtgcaggaggtgctcatcgtgcgtgggggagcaggccatgcggccacacactaccccagagtcgggggtcgggacacagtgcacgccgtccaggccgcggaagccgatgtacagcaggttcccgttgctggcgggcggcggcgccacggcactcatctccacactggccaggctgcagcgccgctgcttgtgctggcaggccgggcgcaccttgtcctccccgggcctcttcattcgcaggaaccacgcgcaccagttcagaaggatgactctggtctggggagacaacagaacgttaagagcagccctgaggcggacacgggctgatcccaacagcagtaagatcctacaatacaagccctgcttcattggtcctgggggtagcagcctccactgcctcccggatgattttagcaggcaagcagtgcttgcgtatgacaagcagtcgagttcaacgtgaggcaagactaaaactgatgcaccctgggaacaagctaaattgttctccggggcaggcacactgcaatctcagggaagacagcttcgtggaaggggaaggctatctgagctgtgtaaagagggaaagtcaatttccctctctgatccttcctcatctgtaacccggggaccttcagatctaactctggctcccacactacctgttaggtgccctggaaggccactgcaaattcgcaaagagtgtctgggggaggttgtacattttcaaatgcaatcccaggatatccatgagacaccaggtaaacttgaagcttgaagcagttcaggcttccaacatcagattaccacatctcttgtgatgacgtgaccactttgcaaagctgtttttcaaagtaccctgataaaaagcaaacaccaaggaacttcatgtgaaacagaaactaggttagtggtctccaatctgatcccaagatttgagaggcggtgccgtgccccataggtgctacattgttaaggcacaaatacttattaaagtgttttgatctatttaaaaagagagccttgggtattatttcttttggccaggggctctgtgaaaaatttcctgagatactaacgtgctgtgaaccaaggcagtttcggaacctctaacctaactcagtaggcttcaatgaagaccgaataagatgatgtctgggagagtactttgaaaagttgaaggcagaagttggcaaactttctgtaaagggccaggcaactactcacttctgctgatgtagcacacattgaaggcgtcaaatggatgggcatgttttctaaaataacttatttacaaaaacacttggtggactggatttggccacctaggccataatttgctaacttctggtctaaagtgtgtcctagagtgcatgaaagaagctggagaaaaatcaccatggagtttatcctggttttgcctctcatggaaagaagagagacaactgaagcctcaatccaggtaaagaagcattcttgcaagcccatccatgtaaagtgtatgaaaagtgggccttttccctgaaattatccagatcctgatttcatttacattttgttttatgattttggggaaattccatcagtaacctaacaggtttatttcctatctttaggaaataaatataca

SEQ ID NO: 6 - DNA, 2412 bp, Homo Sapiens
aggcccagtgtcttctgtctaaacacactggctgtttggaagcctctgagccttgcctgctggtcaggttcaaggaaatgcttggaaatttgagaaccagagcattggcctgggctgtggctctcggcagggagagacggccgcccagagcagcgagtggccaggaagtgtatcctagccccccaccccgcccccgtgtccaccgcaggacagagcttcggcagaaagcacctcagctttaggtgaattcgagctaggacaagttccgcgtttccctccagcccagcaggcagacggagggtctgtccctcctccagaacggtcccttgaccccagagatgtgaggacaggctgcgtgggcggcgggtcctccatgggagcctgggctggagagagtgctgcctccttcctctctccccacccaaggctgctctcattaaaatcaaatttagcctcttgcatcattgtgcccctggttgttggaacaaaagcagagagctggggaaggttcctgacagactgggcgtgtctgtgagtttcatgcagcctgtggtcaatggtaggttctcccctctactccaggggagggccacagcccctcgcaccctcagctgaggtcatggttgggccatttcggtgaccctgggacagacgtggcggggatggcagggcagcgctgacgtcctggaattagttttgctgtagttagagctgtctgtggtgtctccagagggtgagtaagaattacaggcctttcaccgtgttattagttggcagccgagcggccacagaagaaagcgcagacgttgcagggccctctttaagcagaggcgccttcaacacatctgcacttgcttgaacccaaagttaaaaacactggcgtcggtgccctctccccgtcatccgactcacgggcctgttctttccatgctgatgttcgtcctcgctgctccctgcaggccgcatgcgggtgctgaaggtgcagaattcctctcccccggggaggcggccgtggactcctatcccaactggctcaagttccacattggtatcaaccggtacgagctgtactccagacacaacccggccatcgaggccctgctgcacgacctcagctcccagaggatcaccagcgtgggtaggtgtccttgggtgcactcagggccgtctgtgtgccggctgtgtggcatcagggctgctggggcaggctatgtgttagagaggtctgggaggccgttgctcattacggcagcgtcacctcctgcagcaatctgcacgggcagcgaggagggacagagggctcgcgtctcgtgtgctctcacactggatgtgctcctgatctgccgcacgatgagcggggagacgcctggacagccggtccactgcgctctgcgtcctcacctgggtggtcccgggggtgccaactggatgacagagtccttccctcctggggtagaggaatagaggggtatctctggcggcggtgacccctccaccggaagcgtgtgcatggaactctcctgcttttctacacacgaccctggctgggtggggagacagccatgagcctgcttcttgtggttttgaagccgtccttcgtcagacctcagcaaggcgctgtgcagtttcatactgaggagacataggcagggctcaggacggaggcctgggcctcccagatggaggagtttgaaggcaacatctccaggtactttgggatctgctgaattggacaaaaaagggcatccagttgctgatttcaggaaaatatgccactgcagcttctgagcgtggaggtttggtgccattgttctcagcttgtaggcgattgtttgtgaaggtcccatttgtcaccagtgcttggagaggtagtgagggcggggctgaggccctttagtgggagcagctgctccccggggattgcagggagtgggcctgggtgcacacagctgtgggcaggtgcagaggccatgacagcctgaaggcagggctttctttgcgctgtgtgatgaggccagcagtcccaggcattagcttcatgtgtgtctcagaagcaaccttggtgctgaaagggtcccagcagcctggggttctgtccagttgctgacacaggacttaggtgtcccctttcaggccagcaggtaggttctcctgagctcttcggggctgtttctggctctctctgccgggtgctgagttgtttgctgggcactcacctggtcatggggagacagaacttgcagctctctccccaccccttgatcagctcacctcataacagagatcagctggacaagctgggagtcctcttccctccatgctgcctgggagtaacctgaacccctgcccccctccaggcccccctccgtgaaagcgctgcctttctcctgcccctgcagcggtctgagggct

SEQ ID NO: 7 - DNA, 2225 bp, Homo Sapiens
gcatgcacctctatggactaagttgggtctaagccccagtcacatgcagactgggaagatgtctgctaggtaagtgttgagggcaggtccaccactgactgactgtggcagacttggcaacagcagctgtcacccacagcagtggcaattccccgcacctccccccccgaaactaggacatgtttggcgatgtctggagacattttgggttgtcacaactaaggacggtgctcctaactctagtgggtagcagccagggatgctggtaaacatcctagcatgcacaggagggtcccacaacaaagaatgacccagcccgcaataccaggaatgccgaggttgaggagccctgccccggagcactgattcatgccacatgttgggcctcaagagcttgtttaatccacataatcctgtatggtgggtggtcattctcattttccagatgaggaaaccaaggatcagagaggttaagtaactgacccgaagtcaaacagcttatgagtggcagagctctattcaaactctgagcacatgcctttagccaaagctctgcacctggcagacaggcccaacgataatgcatgatgacaaccagcctgggcaccgcggtggagtgccgcaggcttctaacagcatggagcaggtgaaggggctctgtaagctgtgtaaatgatgatgctgtcaccggccacattactgggtgagtcattgtgcaagaaccgtactcaggtcacacccctgcgtccccagcagctgcccggctcctggtcctagagagcctcgactccacctctcctgtgaagatctggccagcacctccccgtgagcgctcctcaccttgccggcatagtggataatgcagaaatcagctttgtccttcagctgcttgggcttctggaacttggggtgggtgccctgctcctgcatcaccttctccacgaagctcttgtcggtggctttggggaaccagcactcctcgtccagcagggccagaatgcccggggggcctgcctggaggaagcgcagcatcagcacaggtgagtgcaccctgggaggggcaccccacccttcaagaagccaaagcccggacatcagaatcccctgaatcccacagacggtgggcgacacactccccaggagaagcaaagcactgttgaagatttctagcttctaaagaaacctctggggcccaggctgcggctgacacctttacccaaggatccatcgcggtggttctccagcattagtgaaaccctcagtgggtctgatgaaaagtgcacatccgctgacccgcggggccagagtctgacttcacagtgcactggggtctgcccaggaggctgccctcaacaagtaccctgtgatcctgccacgggagatgccaacccacatgctttgcgtctgcatgtctatgatgagatgggatatgtaggaggagccccttgaggaagatagtcccagggacccagcagccttctgcacactgagtttacaagacaagaaagcaggtttggacactgcagagaggctgacaaaacttgaagcccagtgggttcctattagttggaaaattcaactgattaaagaaaaaagctcattacaaaagtaaatttttggccaggcgcggtggctcacgcctgtaatcccagcactttgggaggccgaggcgggcggatcacctaaggtcaggagctcgagaccagcctggccaacgtggtgaaactccgtctctactaataatacaaaaataagcctgtaatcccagccactcaggaggctgaggcaggagaatcgcttcaaacagggaggcaaaggttgcagtgagccgagagcacgccattgcactccagcctgggcgacaagaacaaaaatctgtctcaaaaaaaaaaaggaaatttttttcaaactgaaaaaactttgtcctaggccttctgatcaattaaccataatcaaaagaaaacccagagacaggccaggcgcggtggctcacacctgtaatcccagtactttgggaggccgaggagggcaaatcatgaggtcaggagattgagaccacggtgaaactccgcctccactaaaaatacaaaaaaattagctgggcgtggtggcgggcgcctgtagtcccagctactcaggaggctgaggcaggagaatggcatgaacccggaaggcggagcttgcagtgagccaagatcaggccactgcactccagcctgggcgac

SEQ ID NO: 8 - DNA, 2205 bp, Homo Sapiens
acttgctctcacgaaatggtacaaaactgggttaaaagccaagggaataggtgtgttaaatttaaaagttcaagtacatcgtggagttgaatgaaaaatagttttctgaataactaccattaaatgagtaaaagtccaaaaataatgtaaaaagtcaaagtcggctgggcgcggtggctcacgcccgtaatcccagcactttgggaggccgaggtgggcggatcacgaggtaaggagatcgagaccagcctggccaatatggtgaaaccccgtctctactaaaaatacaaaaattagctaggtgtggtggtgagtgcctggtggtgagtgcctgtaatcccagctactcgggaggctgaggcccgaaaattgcttgaacccaggaggcgggagggtgcagtgagtggagatcgcaccactgcactccagcctggcgacacagcgagactccgtctcaaaaaaaaaaaaaagtcaaagtcgtctgagcaaacaaaagaccagacaaaaactttatgaattaaaaactagccataaagttgtttaattagaacaggatgaggaagaaaaggggaaatcgatcactcctgattaagtgcaaatcccaagtaaattattgatactaacagtgagctggagcactttgccttaccaggcaactttctgcaaatattctgcaacgactctacatacacaaagttttcctatgcttttcctcaaaaatatgagacttcctcaggttaatgcccaggtgagatgctttttgttgctctagcagtttagttctattttctttcttggttattatgaatgctctcttacaactggagagctaggatgaaccaatcccgagtaagaaacgggaaagtacagtaaagaggcgacagctctgcacccccacacggaaaaagactcagaggagagcagcggcatccttgccctagctccaatccgaacggaggcaggattcccaacaacatcggacgtctccctccctcgccgccccacgccctcccgacgaagaagcaaaaagtggagagtccagccgcttctcagggccacggagcctcccagtcagggattctctcccgttacataactaaggcctagggccctgcttctgcgattagtcctctggaaggagacggacgggttctccagagaccctcccagggaggtggaagcggggctctgcacctagtcgacccgggagaaagaagtgggacgacatgagggaggccgccaccaaaggcggtggggtacgggggtgatgagcgagcccggagaggggcgggcggctccgggagccccgcagcaggccccggcacctccggccgtagtcggctcctctccctcgcctgcctagtccccaccggccgccccctcccccattccgcgctcccctcccccgcgcctccatccccgaccccagcctagcggcaggcagacctgcagggaaggccctggccaccgccgttggatggctcccagcccggtacctggtcagacatgatgacggtggcttcacccgggggtctccgcacagcagcggcctcgggtaagcagaacctcgctccggggtttacaaatccttctcccttccccacagcacaacaccgcggctgcagtaacttccgctacgcctcgcgtcacttccgcttcgcgcagggaggagggagagagagaagagaggaaagacaaggcgggaaatgggtgggggagcagccaaggggaggggcaggctgtggagctgctttgccggtggtcgcgcgggtgaacggcagttttgtcagctccttcaaggaccaggtcctgcgcatcagtactagggccatcccccaggagcaaaggtcctggctccatgtctcaatgtttggagccactctcacaacctagattgctctctccgttacaccttgcgcgtctctgacgactgagccgagatacttcttttgtctcctcccagccttgctcatcaacccccaacccccaaatatgtttatttgaatgccagtacttctagctctagaaccaacattttcggttaaccagcacccttgccaaacacatgaccgtgatttaaaacaacaagaaagcaacgacccaacacaatcttgacggctactgatgctaaagaccgctgctgaaagttctaaatggggagtgagtaattccaacccttgaattggttgctttgagttaaggtta

SEQ ID NO: 9 - DNA, 2355 bp, Homo Sapiens
tgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcag

SEQ ID NO: 10 - DNA, 2380 bp, Homo Sapiens
gtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaaccgagtgatgatgtccttatctatatcatcttactgcccgtgtgtgtggactttaaattctgaacccaaatgagggggagaaaaccaagctgactttcatgactggcctctcagggacgtccaaggaatctatgcatttcaagaaacaaagttcatcagcttctctcctaaggtgtttgcccacaatacccagagggcttggccgcatcatgtgtgatgggtggggagctccaagcaggtgggcaggacccaggggcctggtgaccaggacagacccccactgtccatcacctttcctggccctgtcctcagctaaacttcccacaggccttctgcccaatcacacagagtgtgcccaaactctctcaggcctctggcagctgaaaaccactgctttaaatccctttaccatttactatgacataaggttattgtaaacaggaaatattctattgatgctacaaatagaaagccaatgcctttaccataaatagaaaaacaaccctaagaaacaagcaaaacaaaaacaaaacaggggctgggggtggtggctcacgcctgtaatcccagcactttgggaggccgaggtgggcggatcacaaggtcaggagttccagaccagcctggccaatatggtgaaaccctgtgtctaataaaatacaaaaattagccgggtgcggtggtgggcgcctgtagtcccacctacttgggaggctgaggcaggagaacagtttgaacccgggaggcagagtctgcagtgagccgagattgcaccactgcactccagcctaggcgacagagcgagactctgtctcaaaaacagcaacaactacaaacaaaaaacagggttaacaaaagtatggaattcaattctttttatatgctgcagccatgttccagccctagatttggctgggcatggtggctcacgcctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaaccccagctactcaggaggctgaggcaggacaatcccttgaacccgggaggcggaggttgcagtgagccgagatcgtaccattgcactccagcctgggtgacagaatggaatgagactctgtctcaaaaaaaaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgaggtttctctaggggaacccacctcttagaatcatccagaaacaagtcactcttcacctgtccagcaaaggcctgctgagaggtgcacagtgtctggagtccaagctgcgccaaggcggcaggacccccagcccagcccaggacccccagtagagccctcacctcagcgtggaggcctgagaacgtgaggaaggagctgtccagcacggacgagtccaggcagctgtcgatgtccagcacctgctgcccggcaggtgtggggctcgggctcccagccacctgcaggacgacagcagtggtcagcgggcggcagctcagacctgctcaggacctggatgagaagccacctcctcagcagacaggacagagcccggtgccatctgacagaatgtcctagaatgctggatatatgggacatctgcaccgtccgtgatggcagcccctcgcgacgtgtgccactgaacacttgacagcagactggtgcagctaaggaacagagttttcaatttcatttttttttttcttagatggagtctcgctctgtca

SEQ ID NO: 11 - DNA, 2308 bp, Homo Sapiens
ccaggcaggaggcagctagctggtgatagcgcgcgtgaccacagacctctgaccctcatagtctcagcagctgtctgcaggccctccacgggaccgcagcctgggagggcaggaggccctgcacctgcggccggtctgacctgctcctcacctccctgcctgcctcctccgtgctgggcgccgccgcgacacgtcccgcggacattcaggagtcccttcagtccctgcgagcgcggacccgggagagagctctcattcaacgctgaggccactggctcacagatctccccgggtcaccctgcgaagtgcttggtcccccccattcccagccctgcagcagcaacaaacgggaaggaagtgggtgacgaggacaggcagagacccctcccacggggccgcccgcatctcacctgccgtcgcggggcgggcgttgcggccggtgcccagctgcagatccgcaggcgatcgcactcctggcggccccagctttaagcaggcagcggccgatccgccctgctcgagggctcagggctgacccaggtgagccccggcggggagggcgggcgcctcggcctccccgccccggaaccctgcaccgcccagagccgccacgcctcccggctgtaggctccgcatctgtaaaatgggccgatgaaccccaagggtcggctcagacccacggactgcagctgcagctgggctagaaggggtggccaggggagccgatttcatccttttccttcctccacgccaaccaggagcctccatctgcctgggaccctttgggggcacccatgggcccacagccgcagaaccacagcactgggtggggtttcagccctggggccaagctcttgtgaggtctgtcatcatcttctcctgttgttttgtttttttgtttgtttgtttgtttggtttttttttttttgagacagagtctcgctctttcacccaggccggactgcagtggcgcgatctcggctcactgcaagctctgcctcccgggttctcgccattctcctgcctcagcacccccgagtagctgggactacgggcgccgccaccgcgcccggctaattttttgtattttttagtagagacggggtttcaccgtgttagccaggatggtttcgatctcctgacctcgtgatccacccaccttggccttccaaagtgctgggattacaggcgtgagccaccgcgcccggcctgtttttgttttttttttttttgagacagttttattctggttgcccaggctggagtgcagtggcgcaatcttggctcacgcaacctccgcctcccgggtacaagcgattctcctgcctcagcctccctagtagctgtgattacaggcacgcaccaccacgcccggctaattttgtatttttagtagagacggggtttctccatgttggccaggctggtctccaatgcccgatctcaggtgatctgcccacctcagcctcccaaagttctgcgattacaggcgtgagtcaccatgcctggccagtctcctgtttttttaaaaacttattatttagccggtgtggtgtctcacacctgtaatcctggcactttgggaggccgaggtgagcggatcacttgaggtcaggtgttccagaccagcctgggcaacatggcaaaaccttgtctctactaaaaagacaaaaattagctggaggtgctctcttgaacccaggaggcagaggttgcagtgaactgagatcatgccactgcactccaacccaggaggaggaggttgcactgagccaatatcatgccactacattccagcctgggcgacagagcaagactctgtcccccccaaaaaaaaaacagaaaaaaaaaaaaagaaagaaatctgaagcaattatgaccaaatgttaacatctgtttcttcacgtggtgggtacaggcgtgttttggaagcttctatgcttcctgtattttgagatcacacaaaattatgtttattatcttattgtgctacatgatctttgtagaaaagttggtaaattctggaatgcacgaagaaaaagattataatagccagtaatacccctgcccagagagacagtatccattaatttttctctgcctatgtttgtcttcggaaaaatgggatactattggcactattttataactttttaatttgtattaacactttctatattttttaaattgaaaaagctggccaagcatggtggctcaggcctgtaaacccagccaatgtgggaggatcgcttgagcccgggagttcaggaacagcctgggcatcgtggcgagaccacattgctacaaa

SEQ ID NO: 12 - DNA, 2352 bp, Homo Sapiens
aggcgactcctggattcaccccctccccaccattgtctctggacctgaggcccgcagtgctctggcagggccagcaatgacgctgacgctgggagagatgtgatcagagggtggagacatgcccgcccatcaccaccctcgcaggccaactctggccagaggtggccattcctggctcccataggctggaggctccatgcacttttgccagccaggcctcggggtcaggggacacgagagcccccacacctggcagggtgggccgcctcccagagagggagcacggagcctgctccacccgccgtggcgggcttcagggctcactgagaggcgtcggccagcgtaagaggatacctcacagttatgcaacccgggccagcgaggatgggcccgcagcccggccagccaaaacaagcaccgtccggctccagagtgtgaaattgtcaggcccaattaaagggagctcagggagccggctgggggctggacaggggaagagccttcctgggaagggctgcaggctgtgaggcttgatccactctgtggaggtctggccctgctgccacccgggcaccctggggaggacggggggaggcgtccggagccttctcctctttcgcccagttagactgggacatttcacacacaaacacggtgcaagatggagggacagccagagacactcttgctccctttttctgcctagggagtcttggaggccggtccccggtgagacatgggctctctgagcagccaggccctggtgggtcctgagattctgacaggagcccaggcttggctgttaccgggaattcacagtgcaggggtaggagccagcgtcgactccagggtaggaaggggcatcccaccacctggtgcagggcctggggtggagcgaatgccctctaaatgttgaggaaaaggaggaccatgtgggctgtgctgggctgccctgggggtgcctccaaggctttggggtgactcgatgttgggtatggcccgggggaagggagacacaccaacgaggcacgttaccctggcgtggcactccgtgtctgtagagggcacaaccccttttcctgccggccatctccagggccagccaaatgcagcaagaggcaccaccagccccaagaggaggtgaggggaacacgctccacttcgtgcaccccaggctggggccccacgagcaggacatggctggcctggagccggtcccggacgaggctgaccctccacagcagtgaaggggcagcagctgggcaggaagtggagcctggtggagaccactaggggagcgaggggctgtgcggctgagcagggggcgcatctcttatctcatggagcccgggagatggttcccataaagcccatccccagacacaggaatgagaaaagcaaaactgaggctggaggaaggcctggaggcattggctgtgtctgcagtggagggaggggctcagcaagaaagcctgggccacgcgggaggcatttccgggccgggagtggcgggagctgcgagcttcccatggttttgtcgcgtgtgtaaggcgtggggagtgggtgagtttgcgcgtcaccttggctgggccacctccacccaacttcaccagatgttgtggtgaagatgtgtttagatgtgggcacacctgacatccgcgggctctgagtcacgcaggtgggcccctcatcgtgtgaggggcctcatccaatcaagggaaggccttcagaggaaaagaccagctccccaaggagggggtcctgccctcagatgcaaaaccgcagcatcaactcttcctagatctccagcctgtcaaggctgccagcgccccccacaattgctggttccttaaactacccccccccgccgcttctcacacacacatacagagtctagcacacttcctattgattctgtttctctgaagaacccttgccaacaggaggacagtgatgggaaatgtttatgacgttccacgcacgtttaatgcaacatgtgctctgctcaaaagaccccttgctgtcaagcgcttcctatggtgcaggggtgccacatgagagcccaggagggccctggggcctgactggacagagccaggcaagggctcgctggtgttgggatggacactcatgctgcccatccaatcagggtccccttggagaggaagacctcatgtggggaatgccagctccgctctgcagttgaggctcacatttttgccgtgagcattttggacgtgttgcccggcttgctggctttggcaaaattcctcccatttgcacacaaagctctgagtgctctagcccctgtccctggatatgaaacacagggaaatgacattcagccaggga

SEQ ID NO: 13 - DNA, 2229 bp, Homo Sapiens
gaacaggcctatatctacctcccgccctccctccccaccaatctgggagagggaagagcagagatcatggcctcaaagctctcgagcacctggctgaagcccagtgctgggcgccatgtgagctggaggaagccagggtgggtggagcccaggctggcttgattgtgaggtctgtcagtgcttgtcagtggggcgaaggttcagagatgccaggcgtcccaagggtccacggcgagaattggttgccagccgctgctgtgccaggaatgactgggcatgggcaggcgcccgctcctccccagctcgctgctgcaaggccatgcccttcaggaggaggtgtggttggggtcaggtgagctcacaggacccccccaccaatattctacccatgagatcttagagcccagaccccacacttaccatattataccaggcactgatgagcagcttttcttcctgctcccgctgacttcggcttttctcaaagtccatctgtcaaggaggcaagtgtcaggggcctagatacgttggaggcagcgtaaagggacgaggacacccacctccaggtgtcggatgcggacatcccgttctcggagctgtgtcctcagggaatggagttctggaggtgcccccgcagctggccgctgcttgggttccatggtctgcatgacctacaggttgaggaagtcatagccaggtgactttggccttgaaaccccctgggacatactggggtgtgtgtattcattcattctttcattcattatagagacagagtccccctatgttgcccaggatggtcttgaactcctggcatcaagcaattctcctgccttagcctcccaaagtgttgaggttacaagcatgagccattgtgcccatccagccagtactttatttttactttatttttatttttatttttgtgatggagtctggctctgttgcccagcctggagtgaagtggcgcactctcagctcactgcaacttttgcctcccgggttcaagtgattctcctgcctcagcctcccgagtagctgggattacaggcgcatgttaccaatcccgcctaatttttctatttttcgtagagacggggtttcgccatgttggccaggctgctctcgaactcctgacctcaagggatcagctgcttcagcctcccaaagtgctgggattagcggcgtgagccactgcgcctggctgtgcgtaattttttttttttttttttttttttttgagatggactcttgccctgtcgcctaggctggagcgcagtggcacaatctcagctaactgcaacctccgcctcccgggttcaaatgattttcctgcctcagcctcctgagtagctgggattacaggcacccaccaccatgcccagctaatttttgtatttttagtagagatggggtttcaccatgttggccaggctggtctcaaactcctgacctcatgttccgcctgccttgacctcccaaagtgctgggattacagccatgagccacggcacccagccagctgtgcagtattttaatgtgacaatcagtagcagtggggaatcatgcagaagtctgtcttatggtggggtatgacaggtatgagttgggggcacagatgtgcaagcaggaggtttgactcaataggaggcacaaaaagtaagaagccagggcaggcaacttgtgggaacacccagcgtcctcaccatgcgggccttgtccacgtagcggcggtatcgctcctccatggcccgcaagtccgcgtccttcttctgcaagttatgctgcagctcctcgatccgccgggctgctggcggaagaggtggcccatcagctccacgctgctgggctctgggatctccccaccctctggtcactaggtcctacttactgctgctgtcagtgggtggctccagctcctcaatgtactcccgcttcctctgcaactccagatctgcctcatgaagcttctgcctgtgggccggggatgagcagcagtgggctgacctccgggctggcttctcttttgtcccagtggtagccacagacctccccgccagccagaaatgcccctacatggccacagagccctctctgcctgcccctcatgcctggggctgtgtgccctggtcccaccggctccacagctgtcagagccacaaccctccgcacccttagcaggtatgccccggaacagcccctgctgtccacttcttcccatcccacagc

SEQ ID NO: 14 - DNA, 2280 bp, Homo Sapiens
ctgccttggtcctatgcttgtaaggtttccggcctaagaggcccatcgactccttctgccttctttcagttgattacaaaataaataaataaataaataaataaataaataaataaataaaaaagcaggacattaaacctgccacctccagagggtcctctagcttccttctccactcctgaattgagcgaagcggtgccgacctccaccctttgggcacgagcccctgcgcacttgggagactcctgaacaccctcggagaagccagaaagccccgggagatggctccgtctgctgctgtaccagaccgggtcctgcaaaggatgcatcctccgagcctcctccctgcacgtccagtggggcctgccccgattctacctgagggacccactggaggagaggcacggggatgctgcctgagcagcggacccttctggcgcggagcaggctgtccccaggcagagtccgacgggtccttccttctgggtgcccccggcttcccggactccagcaggcctgggaaggccccgggcccccttagccgatgcccagagagtctccatttctcaagctttgccaccgaactcatcggtcggtgcgcctctgatcgcagggcaagggcctgcgcacccccaaagacaagcggggtccccggaaggcccccaggcagaaatgagcaccacggggaacggcccgcctccaagacaacctcggggacatggacacaacaagacagggtggcaagtctcaacaaggcgggtgcgcggcgtctgagggtggccgggccgggccgggcctggccttgcgtccacctcgtcaagaaccgtctgggtacgggccccgcgggatgccccgcggcccaccttcctccctaggacgcaaggaggaacgccccggcgcgcggccagcagcggcgggcaccggcccaatggccacggaactcagcactggcagtcggccctcctcacaccgcaggcgtgcagtgtggccgacggagcctcccgggccgaggacccagctaggccgtcaccccggttgctcccacgggaaggggcaccaggcaaactgcccaaggccccgagcccaggctccctggcggaggcctccgctggtcccgcccagatcatggccgccaccaggctcccgagccatggcttcctgtccgggaacggcccggcgtcctggctgtccagctagtcctggcgcctctctctggggcttccaccgcccgaccccgcggcggagcctgcttctctcggacctccagagacctcggatccgtccgagcacctgccctagtcctgcctggtcccccaggacagtcccaagccactcctccccaggcgagcacagcgaagggtgcgcgggattgccaagccagttcctcttgatggcagtattgctccagaaatgcccacctgcccttcccccacgtccactccctccgccctttgctgaggaaaaaacgccaacagcgccccgcacatggcggatcagcatctcggccgctttgggccagccctggcccacctgcgggaccctgtccttggcagatgggactcggcgggacccttcttactagcctgccttcctgacaaaccagaaagcggtccccttggaccgccctggggatggacccgacctaaccgcatccctaacgatgcgttaggatgggaggatggtggaacccgcagggacgagaaggagactgggcacacactaggatcccagccccggccctgccccccgggacacattggcacttgggcattctcacgggtcacggcaaggccagcttgaccaagaggtcaaaggcgactggcgtcccactgaccgctgggggtttggcctcaaacttcaggtgaacccacaattccggaatagcgggaccggcacccgggcccttctcacgtggcagcaccggcaaggggctgggggaagagcccacgccagcctacgtcacgcaggaagggagccagtggccaccccaaacacacctctcctcctcacacctggcctacgtccaactctccacggctctgcccagaaggctgcacgtacaacacacacagaggcgggcatttccctgacgactcgtgtgtgccgtgggggagcggtagatggcccagccccaagtgttccgatcttcctgcccaaacatattctgtgacggaaagcctatgttgacctcgtccggcactcaaggcgtgggcagcggcctaacgtctgctgcgggaacacagtcgcgttgaatgctattctcaagacagacaaaacagt

SEQ ID NO: 15 - DNA, 2438 bp, Homo Sapiens
tgtcgtggaggtaaagcgaagcaatgcacacaaagcagtgagcagacgcctggcatgtaatcctagttaacgcgggtcagctctgacagctggggctttgcacgcagggaaggtagggtcacaggcagaggggtgtgaggattccaccttcatttcctggtacccatataactctgattctgagcccaatttgttcaccgtgagcaccagggcatgcaggggagcacagtggaggtggcagcccagggaaccctgtaggtgcagggtgagggcttccagagaaccccagcacccggcaccaggccagattctaccagaagaggccgggcgcagtggcttacgcctgtgatcccagcactttggaatgccgaggctggtggatcacttgaggtcaggagttcgagaccagcctggccaacatggtgaaaccctgtctctacgaaaaatacaaaaattagccgggcgtggtggtgcatgcctatagtcccagctactcaggaggctgaggcaggagaatcgcttgaacccaggaggcagaggttgcagtgagctgagatcgcaccactgcactccagcctggaggacagagcgaggctccatctcaaaccaaaacaaaacaaaaaaactctacaggaagaaatggcattaccattttattggttctgccagcactctctggaaatggtctcaaagggtctccaaggttcagggcggtgtgggccagtgggaggccatcttgctctgcaggaataagggagagacggcaccagccagcccctcaccaccccccgggaagacatgacgaaaatcgactggatggtagattttctcacgaaactttcactaggcggccagggctctggtgggtacacgaacacgcatacagacacacgtaccctcgcataaggccttcgaggccacgggtctcttggccagcgctggcctgctcgaggcacacacgctggggccagtgggggacgtgggcttggcctctgccccgggggggctctctgtggccagtgcaggctcgagggtgggaatgggcttccccagtttggcgtgcagcttgaagacctgcaacagacagagccgggctcccgcgtgagggccgctcccagcctgatggcctttttcaagaggcaggaagggcctccacgggcgtgcagcgcgagtgtgggctggccggtcccagggacccccctctcttctctcctcctgctctctggataacacccactccagaaggcccttcccaggtggcctcctgccttgcacacgtgcttgtgacttctctagcacggtgacactcctctagtgtgtgagcacgtggctcaccggctcacacggacgctcttcctcctcctccaccacgtgggctgccaggtggggccgtttctcagcctcccaagccccagcctagtgctccctgactgcccgggactcagcatgtgtggatggatggtgggtgtgcacgtgtccctggacggacacccacgttctgcacgcacgtgtgcacatggtcacgtccgtattctggccgtgccccattctcagcacctctaggtacaaggtgtttctggcaaaggttccgtgtgcacagggccactgtgtgtgtgctggggaccatctcagacacacttcccagctctgtctctgacacgctgtaccctggtacaagacctgccctgtaccccccaaccccacaacgggcagcagggcctgcctgacccccagactgagccccagcctgtgggggtgacacctgcagctctgccccaccggcccctagctctccggtccccaggccaagtctccttcccccgtttctctgccccgctccttccctcctccatgcctccctgctcattcctctttcccctgtgggttcacacgggccctcagcaagctgtcctgagccgagccagggaatgaggccctggatgagcctccaggcagctgggggagagaagccaggtcctcagccaggcctctcagggtggctcagcctgacagcccgggctacagcacaagccagctgtcccctccctgctctcaggtggggactccatcccctccccgccgaacatgacgaaacccaggcctcttttttttttcttttggcgacagagccttgctctgtcgcccaggctggagtgcggtggcgagatctcagctcactgcaacctccacctaccgggttcaagcaattctcctgccttagcctcctgagtagctgagattacaggcacgcacccaccacgcccggctaatttttgtatttttcagtagagacggggtttcaccatgttggccaggctggtctcaggctcccaacctcatgcgatccactcgcctcggcctcccaaagtgccgggattacaggcgtgaggcaccacgcccggcctgacccagaccttactaaggcctcaggagaacag

SEQ ID NO: 16 - DNA, 2403 bp, Homo Sapiens
agaaaagccaaatccagcccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccacagggtcccagggctggtggttgctttgggtctacagctacgtcttacccgcctcctgcctcaacagcctgtgtggtggcaaagccggtgtggggctggggaacgcagcgttctccaggaggggacccggctctccttctgcagtgcaggcgaaggcctagatgccagtgtgacctcccacaaggcgtggcttccagactccccggccggaagtgatgcttttttgccgcgggccctgggtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaaccccagagccggtggggtggggctggaagcagcaggtgcagtgatagggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaactccactgagtggggtagtctggttggggcagggaccgctgttgctttggcagagagagaggatccccactggggagaggctgttctgactctgcaggtgggacagggacagatggccaccagggtgacccggctggtcttcctttgctatgctaagccctgggacatggaggattcctgccacacagcctgggcccgggttcttacctgtggccaccgctctggcatgagcccctcagtcttgggtggtttctgcctggtccgggatttggtgttgctgctgagtccagcctttctgccacctccgcatgggccgtgggtggtgatgtcagctgcctcccaccttggcttcagtagctcacccagcttacaggggagctgccctgggctggagatgggcatgcaccctgggtcctacttgaatgaatgcagcttgaggagacccggccatatacactgggccacaggttaccctcggcaatgcccacatcagccgtcagcctgagcctccccaggagagcaaggctcacacgacaaaggctgcccgtggccagtgaggtggctgagcccagccaggacctttctcggactcccgggatgtggctctgctcgtgagctgcctggtcagctctctcggggtgagaggggcttgtcacacgggcccctgcctgcagtgtgacccttctcagcttctctcagcagccctgcctgcagagtgtcaccaccaccatgatcatttccctgacactgcgagggtcgggggacgtcctgggtagagacagggcccgtggcagcagcaggctcaggggcgccctacactggtgggctggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcaggtgaggaaaggactgccgctggcccgtttctgagtgttcagcacctaagggtgacagcactgtctgtccctaccctccgggtcctgtttgaagatcaaacccatgctcacaggacaatttttttttcttttagagacagggtctcactttgtcacccaagctggagtgcagtggtgcgattatagctcaatgcagcctccaattcccggactcaagggaccttcctgcctcagcctgccaagtagcttggactatagctgtgtgttttattattattttgtagacatggggtctggctatgttgtccaggctattctcaaaattcccggcctcaagcaatcctcccgcctcagcctctcaaaggttgggattacaggtgtgaggcaaggcacccagctcagccacagagccctattgcatctctcttactaggagcaagagctgactgccccctcatccccattccagagtgttggggctgtgttgagccgaggccgggccactggcatggctcagggagcgggatcattcactgctgccccaaatctgagatcattccaccttgacaagacttcctcatccaatccctttacttg

SEQ ID NO: 17 - DNA, 2311 bp, Homo Sapiens
tctgtgacaccaggaggcacaccaagttttcctctgtccctaacacagaccagaggggtggcccaccacccccccgggtggaggatgtgtggagttagaggtccctgggtggccccttggttggccatcagagacccccgggagccagcctgcagggcaggagcacaatgacgtggccaggatcccagaaaggggctggagtgtctgcctcagtttccaggataacggtgcaatggcctcagccaggccaggtgctggctgctgctgggaataatctctgagcttcgtgactctacagtgtgggcatgagggtccttatttcatagatgagaacactgaggcaagtgcagttctcggccaaaactacccagctgatcagcaaaattcagcccacgtctgatagactccacagctcgcagcatcccagcaggaagcagggcaatcgactcaggggccaatttatgtcccaggtttctgagaaggagccctggggaaggagggcggggtgagcgtcacaggctggagggctgcgccagggcaggccccgcaggggcggcgggcacagcctcgccctcgggcccggcctcctcgccgcgcgcgtaggtgagcaccaccgtgacggtggcgaaggtggcagcgttgacggggaaggcgcgcagcagcgtggacgccagcccccgtgtgaagacgcgccagccctcggcgcggtagctctggtgcacgcagtccaggatgccgcggtagcgcggggcgccccgcagtccgtccgcctgcagccgcgacttgaccacgtccacaggataggtagagagccaggacacgatgcctgacgtaccgcccgccaacagcagcttgggcaccagcaggcggtcgcccggctcgcagcccagcgcccgcgtgagagcgtcataggtgaggaagtagacgccgaagctgggcgtctcacgcagcaacgtggacaccatgccccggttgacgccacgcagaccctcgtgcccgtagatctgcgcgaggcagtccagcgagcccttgtaggtgcgcgctgggcccgcgtcctgcagctgcagccgcgtcttggccagctccatggggcagcagatgacgcactggatggcgcccgccgccgcacctgccaggaactggttgaggggcgagtcgtggcccagggcccggagggtgttgccctgcaccccgaacaccagcgcgttgatgaaggtgagccccatgagcggcgagcccaggcccttgtacaggcccagcacctgcggggacagagacgccatcagagccggcaacgcgcacctcccgggccctccacgcggaagggggtcgggggatggcagccccagcccaccccaggggctcctgaggaccaagcagaatttcgttagaacctaggtcctgactggcctcctggtcgtcctgacaccttccttcctggctctctggtctggggtggtggcagcccggaagctagttccccatcctgtgcctcccgagccccaccagcccaggccactcacgctctcttgcttgatgatggacttgaagcagtgcaacgtcccgcggtactgaggcttctccacgctctggacctgaagccgtacctggaaggagagggtccagtgagaggcaggcaggcaggaccagagcacccagctcccgggtctggtgcttaggctgcctaggagggtctcccaaggaggccgggcactcaggcacagtctaagacttttgtaattccagggcagggtgggccgggtatctatgccttctcaggatggggtgccagtaggcaaacagctaaagggacaggctgctggagacagggtagggggtccccaagatctcagaccaattcaggttaagcctcttgtttacactatggctgcacagtgcactgccagtggggcatgaacgacctcctgagactggcccgttctccaggtgatgcttgtcatactgctgagtgagcggcccatgtcccagactaggctgaagggcccctgccctaatgtcccatcagagactggcttcgaggcaataggcgcaaaaagtgatgagcctggccaggtgcagtggctcacgcctgtaatcccaacactttgggaggctgaggtgggtggatcacttgaggtcaggagttcaagaccagcctggccaacgtggcgaaatcgtgtctgtaaaaaaaattagcctagtgtggtggcatacgcctgtaatccctgctactcaggaggctgaggtgggagaattgcttgaacccgtgaggcagaggatgcagtgaggtcatgccactgcactccagcct

SEQ ID NO: 18 - DNA, 2271 bp, Homo Sapiens
agaccctagaggcatcagagttggagacctctgagccagtcaacatcaccttacccctgactttataaaagggaaactgaggcccagagagaggcttgtctgagcccatacagccagttagtggcagggctggggtgaggacccagggacttgctacctgtgaggcgcccctgcatgccacactgtccttctaagaatgtgcatagtctcagagcttgaaggcctaaaatacagggtacagggacactcaaagagtgatttgcttctctcagctcttgcattggcaggagctcggaaggacaacctctgagttcctcctcccaaaactagagtccttgaatctgacaacttgactccaaggatgctgacagcaggtgccatgtctgatgcacaacgaataataaagcactcacctgtgcgtcaggcgtggttctgcatgctttgtatgtatcaactccctgagcctcacaacaaaccctatcagatgggtatgataattcacatccccatttttttaaatgagaaaactgaggctcagagaggttaagtaaattgcccaaggctgcagagctgggaagcagggaagccaggatttgcatgcaggagtctgcatccagaggccgtgggctaaccactgaacagcatcgcccccctgaaggctgggctcttgccacagctctgcctgccctgcctgtgacaggaagcagacgcaggcaggtctgagtttgcagcaacccaccgcagcatgtggatctaggctaattttgaggaagcccttccagactcatgagaaaactgttaaccacaggccctgagtcaccccaggaggaagtcgcttgggtctaggggagatgagtgtggccaggagtttgggagtagggtgggtctaggcaggacagtacaaggacactgaccctcagccaccccaggcagaggggcagccttggcccccgggcactgtgacttgcccaagaccacactgtgagtcaccaggaaaggaggaaccagtgacagccgtgacttcacaagttgcccaacaagagcttgggccggacaagttaccctaatgattagcacaggtctcaagttctctttggtgggcagaaggccgtggtttgactgagctggaagctgagaggacacggcccctgcctccccactggaggcacaaaggggagatccccacttctcatcccctcgagtggcccaggctccctccaggccccaggggaagaatcggggctgtgtctgcggccgacctcacatcccggtcaaacaatcccagcccacgttcctcccaagatccctgccttccaaagcactttcacatctgctgttggctttgcacacaaataaccttccggctgctgctgtgccccatctcacagaggcagaaacggagccagcctcggagtgaacgtcagttacatttgcctggaaagtggattccagctcccttactcctcactcttgcggcatctccccagggtacccccagccatttgacagagaaggaaactgaggcccagagcaggacagggatttgcccagggtcccccagagaggtggagagcaggagttctttcatttgtggggctccgtagatgacgggtcaccgcagacattcacactcacacaagcacgcacgcacacacacccggggcccgcacactcaccacatggtagatggccagggcggtggttgcgatgcggacattgaagcagcagcaggtctggcggacagtggacaagcgggggtccatggtgctgccgtcccctcctctgagacactgaaggggaaagagcctggtgcctggagcagggcagagaaggggaagctgctggctgccctcctcacttccttcctgccccttagacaggcagggacaaggtcgtcacagctggggcggggcagctggggagggggagtggggacagggcagcagcctgcctcagagcaccccactgccctctgccattcccaggagggggttccagagaggacagaccctaacacggtcatcatgcccttctctgcaccagggccagggttccaccgtttcacacagcttgcttactagaagaacactaccaactttggaagccaggactgttaccaagcccatttccagatgaggaaacagctgtccagagaggtcaaggcacttgccccaaatcacacagtagttagcactggtggcagaattcaaacccagatctgtctggctgcaaaaatagctattgtctaggaggcatttcctgcctcttcca

SEQ ID NO: 19 - DNA, 2546 bp, Homo Sapiens
cagccccagcagggaccaggcctgggagtgagggcgagccccttgcgcgaaccctggagggccggaccctaaccctggggctgtgggctctgcccctccctccattcattcatttgtcccgtgagtatcaattggatgtctgcaaagtgccagaggcagtttgcttccgaatcagcactttcttcaagactggactcactcctcgtcacgtgtggggaggaaacttctgaatcactgaagtcagtggctgagttcacaccaccccagccagcccacagcggtcacacccttgctaagcttgctgacgggcagcctcactggagcgcagacgttaccctcccaggaaacctgtgatgaggactggggtgcacacgtgtgctgaggacaccctccaaggccggccccggggctcagacaggcaggctggggccacatctgagcctcctggttttagtgcattcactctggcgcagacagaccatggctgagcgtgtggtcccgaattccatccttggaacagaggaagtttttgttatgagaaagaactccagccacagcggatttgcacctgcaggtctgtgtcttgcgacacttaagggccaggctggacgggcccccacagaggtggaggagtggccggctctggccaagctgccagacaccaccagggaaacaggtgcacccacagagcttctgtgcctgctgaggggctgggagtcgtagcctcaaggagcaggctcattttgttgctttctgctttaaggtggtttttcttctggttggatgagaaaagttagttgagccccccacggattgactcagcagctgagtatgtagaaactggcctggtcctggggccagcatgtgagccatcccccaccacccacaggcctcccaggaggccctgctcccgcagcagagcggccgctgtcaccgaggcaatggccagatcaggaattccaggacccccgggagggtgggacactgcggctccaccggtccctgtgtctatggaatcggtgtcagcggacatcccgttcatggtgggatatgcccgtaggtgtcgggcagatgggggagtttcaataccggctcctttagggggtctcagtttggaggaaaaaagccttatttccttgatgatggtttcattccttaagaacgcactagaatctgccccttagtagctgcctgtggtgtttctagattcgggggcaacgttggctttgtggttcgtttttattttatttaactgtgaacgcccttttactccctgcattgaggtgagacagaggacacggctctcaaggagaggaagaagttgttgggattcccaggcttcatgaggccgggctgtccctgagcctgaggcgacctgcagggctgactgatttctatccactgaggaaggttaggattcaacctcagcctcactttgtgcagccgccatgttagacatgccgccacagaccacggcaccgttgtccctcccgaaagtgctgtcctgggcccggcggtgcagcccctggcagcttgcgaggcccgggctgcccgcctctcccgtggcacaggcttggggacagggtgtgcccgagccagtggctggctcaggaggccacagaggtgcatttgcctctgctccaggcgagcttgggcggttctgggagggcctggggacacagggtgacgtggtgggagggcgctatggcctgtcagcctttgatcttggggcaggtggttctgcctgcctgccacagaggacggggtcctccatcccctcgcgagctcctggaggccacgatgctcctggggacacctcccctttgggaaggtgagggctggggctgtccctgttgccaggctctggccctaggaaggaggtttgtggccccagtgactaacggattcccttgtctgcctgggagtgtgttgaccaccagggagtaaccagggaactggactctccgtgtggcaggaggggcatctcccagccttcgagcctgattgcttttccagtgcctgagctgcacccctgggatcccagctttcccttcccgagtccgggcagcatctgtgctgggccctgctgggaccttcctcctcatgtgaggcatgtcacggctggcactggccccagcccgggcctcgggtgtggtgggcccacagtgtgtcagaccctgggtgtggtgggcctcgggcgtggtggcctcgggtgtggtggccctgggcatggtgggcttcaggcatggtggcctcgggtgtggtgggcccaggcgtggtgggcttcgggcgtggtgggcctcagctgtggtggccttgggtatggtgggcccgggcatggtgggcttctggcgtggtggcctcgggtgtggtggccctgggtatggtgggcctgggcatggtgggcccggccatggtggcctcgggtgtggtgggcccgggtgtggtggcccccgaggaggagtgtgtcctggagaacaggcgggtgcgtgagagctcccagctcagccacaagagcaacacatgctgcccacccagcctcgcct

SEQ ID NO: 20 - DNA, 2251 bp, Homo Sapiens
ggaccccgagccgcccccaggtagccaggagcggcctcagcggcagccgcaaactccagtagccgcccgtgctgcccgtggctggggcggagggcagccagagctggggaccaaggctccgcgccacctgcgcgcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacaggtgagatggcgttgggctgacgttggggtcaacgggtagagaacgcagggatgcggccctcgccgaagagagccaagaagggaagagcgcgctctccaaattgcttttgtaacttgttttcagtgagcattttattgattcagaatctatcgagaatagcactagcgagctacttttcccttgagatgggtcttattcatcttggcaatggagtgagttggattgtggggaggaagaggaatgggaaaatcagtttataaatattaatgtcagcaagagtgtgctgttggcaggacgtatcgcgagcctggagattttggtggccgcagttggtaagtggctacaatccagaaagtaggatcgagttgctccccttgtcttatcagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcccacactgtttctcagagcaggcccaaccctctttgaagtcccaaccctaacgagatttagcaggtgctttgcccctacatcccccagtttatgttcccggaagcctgggtttctttctccaccgagacagcccttaccccttgctgcctgacactggccgagtcttccaagaaaaccccccgccccctctgttagacgtggaggggagcctgctgtagtgtgacttagcccattcctccgtactgtgaactgtgaactgca

SEQ ID NO: 21 - DNA, 2413 bp, Homo Sapiens
tggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccacgttggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagtgtggcagggacggtgctttagccaaggcagggatggtgggtgactcactcaggatcttcaaggaggccgctgcatttccgtgctctttccagataacaaggacgtgtcggtgatgatgagcgagatggacgtgaacgccatcgcaggcacgctgaagctgtacttccgtgagctgcccgagcccctcttcactgacgagttctaccccaacttcgcagagggcatcggtgagcactggaggccttggcctcatgggagacgtctcctccacgtgcactgctgccctcggaggctgtgaaaagcgaggtgtgggaacctgagctgtaacccctctgccgtggtcggcattttaacccaacctcaaaaagcaggggaccagaaccgagcctgtcctggaaggccttgcccatccccagagggctccccatccctactcctcaaggagaccaagaggctgaaatagtcagcactgctgtgctatggggtcctaaagtctgctgtcctccttcctgcagaccagggctgaaggagggtgcctgggtgctcttgccatgggtcctggtccagccaagcatggtttcaaacatgacctgacccttagtcaacctggaggctgatgtctagagcgggtgctggtgcgtgcagcacctgtggcctctgcatcacccttagggcaggtctgcctcccgggcccatgcacagaggacctggtctcccagcctgcaggtgcccctgtggtgtccaggacgacgagggggtctctgtgtacttggtggggctgggaccctcccacttcccacctccttgtgtccctcactcccctgtttcattccatgctgagcctcccctgccttgggctccctggggagggggtggtggcaggagttgcccgagggcagctctgcccatgagcagctgctctagcggctcctcctgctgctgttcgccgggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtcccgggcgctccatgtgaccacctcgggagaggtctccggcttgtcgtaacccaggggagtgacccactgcctcctgcagctctttcagacccagttgcaaggaagagctgcatgctcaacctgttgttgtccctgccggaggccaacctgctcaccttccttttccttctagaccacctggaaaggtagcccagctctcttgtggctgcccaggactccaggtctccaggccgttggggtgcccctctgctcccaccagacccccagcaccaaggaccttttcccccgacccctgtctgcagtaactcactgcttctaaggactagcaccactgccacccccacccctgcctctcctctttgccaccctcctccctctgcactgtggccttaacaaagagctcagagctttggccgtggccagcagtgcacttggacccccctcttccctcccaagcacatcatgaagacctccccatcagcccagagctggccccttgtcctgggccactgagacccagaagtaccaaggctggagtcagcttgcagcacagccagggtcgaggtcactccctccctgaggactctagcacggcacagcccctctgcctctctcctggtggtggcgttgaaacagcaccctctgcttcggtcctctacagggtggcagagaaggaggcggtcaataaggtgtccctgcacaacctcgccactgtctttggccccacgctgctccggccctccgagaaggagagcaagctccctgccaaccccagccagcctgtcaccatgactgacagcaggtccttggaggtcatgtctcaggtatgggaagacagtctccagcccatgcaaccccagcctgacagaggtggcctctgcctgccccacccccagtcctgcccatcttccgacttgcattgtatgtggtggtggctgagattcagagagagggacttgcctaggtttgcatggatgggagtgatagggggtgcccaggccacct

SEQ ID NO: 22 - DNA, 2222 bp, Homo Sapiens
cttattaagaaaatacttgtttacaacaatggtgcagaatgaaaagaggaaaatgttgtcttcaccattaaggtgaaattgtctattactaaaggtttcccccaagccgcatgcaagcttttctacttggaagtgctatcatctgcaataattctttgtaatagcttattggtttagggagttaaaataccacactgtgggtgggaggtgggggctggtttgaaggaggatggatagtgagggtgctttgtggatctcaaatgtaagtcatcaggcttctggtggcttctggtgtttaattccatcttataaaagtggcatgatggaatatgactaggtaaaactctattttctggcattgtggtggtatctttttttttttttttttttactagggtcaacatgtttatctctatgggaaacacacacaaatactaggaagatttgcttcgtattgagattaacagcatcagctttgcaaaagcagcctgacaaaaggctccatacatctaataccagagactagaaacagaccaaaaaaaaaaaaaaaaaaaaacacacaccacacaactggtaaacttatcaacctaggtctatccaactttcgctttcatacacgcgctctaaaacaacttataataaaaatggaagggaagacagatccaatttgaaatcctccttgagaaaaaacaaatcaaaactagttcctggggaagaaagcctcagctaggtcaggaggaaacttacgcatctttgattccctttccgctttggagaggcattacccgttcaagcccagccaatgcggccggccaggatttacagctcttatcaagggttagattttgcgaaagatataaagaaaggagtttcctaacacaccgggtcttctcacagcaacaagacaccgaaattaagccttctatggtttgtgtctgtaggactttttagataaaactggcagccccattagataagaaatggctttttagaagctttgggggaagcgcgggggttcttcgtggccttcctgtgactgtctttgggagaccgtaacagatgatgggaacatgtaagaatgattgaagaaggttaccggcgagttgcacctaacagtcttctctctccaagtagtttctcgagagaaaattatatattaacgcctggggacgtgaaataggtctttcactgttctgtaataaatccctccctactcgcgcccttagactaatgcatttttaaaaaatctccacaaagtcatggagacttgtccttataattaccaaaataccacagctagttgcacaagtttgcttaaaaacaaagggcaggagaccagcagtgagaagaattgaacagtatataaaaatcttacaaactttagactactgaaagatcatttcgctctttggcttcgggttagtgagcttcaattctagagttaaactgagaagcagacctcgcgggtctgaaagacaaaaagtcagtccgcggagtcaacttcggtttaccggtgcgttccaacctgattgtcccaacagcaagaagcgcccctttcctcccacccaacgtttttagatatctgaggttgggggagacggagtaatggtgtagcagtcaggaaacagttcctctgggtttaatcatcccattcccgattcttcttcccctagcgcgccgagcgcagccagttctggaggaactagccctccggagcagccaaggcaggccaggccccggggatgtgcaccacggcgtggggaccaaaccaagctgaacggcctgctccaagttccccccttttcctagagcccgggagggacctcgtcaacaggtagacctacccaccagccactcgccaccggcggcagaaagtgagccccgcgcgcaacgcggccagccggactgcggggaccccaggagcgcagggcggaggagcagcgccacaggaggcgagggcgcaggcggcgcggccgggaaggaacgcgggaggggacagaaggaagaggaagaggaggagagggaggccagagccagaacagcccggcagcccgagcttcgggggagaacggcctgagccccgagcaagttgcctcgggagccctaatcctctcccgctggctcgccgagcggtcagtggcgctcagcggcggcgaggctgaaatatgataatcagaacagctgcgccgcgcgccctgcagccaatgggcgcggcgctcgcc

SEQ ID NO: 23 - DNA, 2162 bp, Homo Sapiens
tggatttagaaagggtgaattatgagggagctggagggctttgccccacccccctccgcgcgcacacgcaagcacaggcagaggcacataccccctccaagtcaaagttgtgagtggggtggtgtttgcgcgtctgtggctgggactggatgtgtcagggatgggaaaacccatcatgctggtcacagaaaatgcgcggtggggacagaagcagttttgaaggaaaagaagaggagggggactgaaagaaagaagggggcgctgaaagggagggcgctgggaggaaaaaggtgcagtgtggaggaagcgcggcgtgggcagggcttgggaagggataacggaatatctgaggtggagtgggccgtggagcgtcggggccggtctgagcagcgggtgtgtaaatggaacagtcccgagatgaattttatgggagtctgcgcaggtccttaatgtgtggctgtaccctccagccccatgtaccccacacgatggacagacagccttggtgtggcagggcccaaagaggtcctatctaccgcaataacacgaccaggcggccctgggggcgcaggggctcggggtgggagcggcggagcgcgcggagtcgccgcggggtggcaggggtgggccgggggcggggccgcgggcgtcggggaggtggcagtgggcgcagggcggggcgagctcagcggagggcgggtttgaatgtgccccggcgggagagggaagctgcagcgagagcgcgcggatctcagcgcgggagcagtgcttctgcggcaggtgctgcccggggccggggactggggactggggactgccggggcggaagacgccgctgcccgcctgccacggagggcagggagggcgggcctgacggctccgcagcccggagaagggacgccgggtggggccccagtgcggagcgtgcggagccgcgcagcacgtggcgcgcacgggccagggagcctgaggaccctgcggggaccgggacccaagctgggcggggcggcctggctcccgggcctaaaacaggctgcggtcacgttgacctccgcaaggggcaggcgagtggacgggtgatccccatcgatctggtcggtatcagggaggggccgtgccgctgactgcgctggcggaggggtatggggatggggatggggatggaggctcgcgagcggaggtgcaggctcgcgagcggaggtgcggggctgtctctttaaccccggtcttttactggctaaactcgtatccctggcgtctccttcctgcgcacgtcttcatttactgatttactgtgagggtatatgagagggtgaagacaaacagtcctcggctttgcttaccaggagagagcagtcgtaggtcaaggctggctccaaccctgccctcacacctctaggggtctctctgcagccctgtggtagtccctttgcctactcctctcggtggcctccagaccctccaactttcctcctgcttgtgtaagctccccatgccaggatgtgtgtgatggggcggggctgagctgcctgacactcaagtcaggctgggaatgatcttggtctccacctcatttttccctttagttgaatcagagttccccccacctcccagtctacagggctaactgagaagcagcttttatacctctctccattccaaaaggagcttgaacatttaatatggattctagctcctccactcaccagctctgtgacttcaggcaagtgactcaacccctctgaacctcagctggccccatctattcagtgctagtactagcttatgggtggttgtgaagaaaagacaagagatctgcaggtagtggctagccccatatgaaatcctgggagtggagaattgcaggagaggtgttgggagtctggaggcagggaggtactcaatttggtggctactttcaggggcccacctcagcaggccaaggcatagttggagggacaccagatgctctgagctggtatcagatccctgtttgccgctgggcaaaggcagacaaaagcaaaacacgaaggctggccagctgaatgttaggatatgggcaggaggagagggctggagttgaattgtgcccaagactggtatgggaactcctgagaacagagagagcaggggtgtagcagggggccagggaagaaataaat

SEQ ID NO: 24 - DNA, 2586 bp, Homo Sapiens
cccgcgcgggcgcgggagtagccccgctgggcgctcgcagccgcgggagtcaagccccctccccaggtgcaggcataaaagtttatggctcttgaacaatgcggggcagaggtttttccaagcaacgtctaattggccgcttctaattaaggaaagagaggcttccagctctatggcaacccaagcagggcagcttcaggctaaaggtactttagaataataagatcattctaagaaatggaatgtctcactggacacccgaacaggttctctgtcattggaattggtgtgtactgtacttcaaccagtactcttgtgtggagggaggcgacccagtctaggaaagtcaactacagaaagaggtgacctccgaaaggattgtcttagcgctattagaatacatgtgaccacaccaaaagcccaggcggacacccgcagccagctcggatttggacaattcaacattgctggcagaactgaagggaacaagttaccccaaccccatcccctgtacgcgtagtgctgagtgagttgggggtgggaggacagcggttcgtttattgcccccttttaaaatctgagatctgaaaatatggaggtcccattcgttttcccagctcttgattgccaacaaaaaaacaaatcccgctggctacattttctcctcattccaaaatagcaaccctatggcttgtattaagcccttcagaagtttatctcatttgctctgggccagggagggaacaatgctaggaaaagtcaccggtgctcttccatcctcgccccttccagggtgcaggatgtgcgggccggcgggcctgtgatcccggaacgcttcctgccatccccttgcgcgaacttgaaaggactgggaggtgttgagagcagagttcagggctggtgcactctgcggtgctgagtgggcggcgcgcccgggcgctcaggccgggggacctgtagtcgccctaccgcggaggggaaaatacgtagctggagggcgtgcgccgtgcgggttgtgatccgttaccccatcggtcatcctggggtctccccaagcctctaggtagggctgtgagagtcccctagagctgaagccccggaggctgacctgtgggtctggctgctatgggaacccggttggtccaaagaagcctttcttccgggcacctggaattccagtttagtgtggggcatcggggaagtggcgctggggggctgggttgggggacctcagccggcagctccggagagggcctacccttggggtcgctgggtgaggccggcacgattcttggctccaaaaggaaagtttctgcttcttgttctggcgcgagaagccaaagacttattttgagagcggagagagaaatgttattggtaacgttttctttggaaagttcgagaggggtcttctggacacactacctagtgcccccaaaccagagaagtagtttttctttggtgcctgggctcagaagtcgccactcactcagcccatggttcgaaatcagcatgggaagcgccggggcaaggcttcgtcggagactagaggcctgcctgtcgggaggagcccctgggggatggggaccccattctcctgcttgctctggttcccacctgggacgcctccgtaggagcccagaaagacgatccactacatggtcccgggacagagcagcgcgcccaactttgagggaactttgtgcgcctctctgaggccctagctttccaaggcaccgccgtccgttcttctttccctagaccgaaactggggaagagtgtgggcgcttctttgccccgatgagttcgcctccccaaacgcctacttcggctgcaccagagcatctgggaaactctgaaaggtgcccaggcctcacacagcagcgtctccctactcagcctctgtctttgggttttttcaagagagtctctacctcatgcctcggtctttcttcgatgtcgggtccccgaggtaggcacggagtccctctgaaagcagttgcctatctgtgcccctttggtgtaaagttagagtttactttgttgggggaaggggaggtagaaaagatcacagttgggaaagtgcgcttttcgccttgttcctaaaacatgcctcaagactgtcatcgcgattgttaggagagctatcaacgtctaggggctataaaggaatttctgaaccctcggcccttcccaaacccccaggttcctaaaaccctagtgggggtctcttggggctgggattcaggctggcaccgctgggaggacctcgcctagcatccctttattaatatttcacgaaggcaggctcctgccttctctggagcctcttttctcggaatgttcccaaactctggctaactcactcccctgtgagccatcctagggctctgtggcccgggaagagacgcgtcaactccgcgggtctgcgcgcagtccttagccgcaaagtgctgcaagtgacccccctgacggccctttccgaccgaagagctcgggaaccaaagagaaaaaaaataactttattttcaaaagaacaagtcatcactgcggcgatactgtggcggaggactttggcgatggggt

SEQ ID NO: 25 - DNA, 2257 bp, Homo Sapiens
gccgggccagcctggaccgtggagctgtgtctccaacgggaaccttggagggcaggactttgatcccctcccgaatttccaaacaggagtttgaacagaaacatgtggactcagggaccagtgcttcgggcacatcctgacagcgacacagctgccccgacagggctgtggccccccccgccccgtctctctcctgtgttctctcccacattctcaggggccgcctgctgccagctccctcgctgtggcctcatccagctcctgctggcgtggtctgacccctaaatgtgtgccagcaaggcctgtgttggagggaggggagggcctggatgggcctggatgggctggtgccagcacccgggaccaaggagggagcttgcagaagggacagccctcggccaggtgggacctgaacgacattttgcggcatccaatgggcctgaggtgtctgcgtgaccatgaggagaagcggaggacagcccaggtgaggacatcagacccaggagtgggtgaggagcccctgcagccaggctatgtgaaccctggctcagcagggtcagcctgaccccttgaaggtgggagaccccttgaaggtgggagacctgtgagctggtacactcagtgaggacggctccatgcacagggacgaagacccccgaggagaccatcgaaggatggtgggcagtgctgcccacacggatgcccagagcgtgttccccaagaccagcgggtctcatgctgtccacacgctcccaccaggcgatcgacaccagggtccgcctgtgccctgcctgggtggggtcagccacgcccccggaccactgctccaaccagcgttcgtcgtcagccccttacacgggacagggcactgcagaccggcccgggaacctggggacacctcacgccccacatccctcactgtttctcttgcaccagaatagctcaggggaaggaaaggcacagaaaataaacaacacacagcagaggaggccctgctcctgcccgaccgaaggcaacttctcccttgaagagaaaggtgcagacaggctccctctccccttccctcctcccacctcacccaattctgggcactttttcagcctgaaacttgcctgagcgagacaagagacactgcgggcccaacgtgtctgtgaggtccctttcccactggcccttcgtgttttcatgtttcagccaaacataaaagcgagacgtctcctgctcagctttcccaattctgcccagccctcgcgtccccctaagtctcatctgcagaaggctgagcctcatgcacctgcacctccttctcttggtgcctgcgcccaaatgtgtggctctgtctggctcaaccctctcctgggccccgtggctgagctggcctgttcttcagttccagctccattccctggccctcttagtcccgcactgcctggctggtcccccagccatctggttctgcactgcccagccatgccatcccctcggcccccgggtcctgtactgcccggccagtctccccgccctctggttctgcactgcccagccatgccatcccttcggcccccgggtcctgtactgcccggccggtctccccgccctctggttctgcactgcctggctggtcctccagcacctgcctgggttctcccacttccctgcagactccaggctgtgcccagagagagctgagctcggcggcccaggcgcctcaccactggccctcagtttcctcttcctccggtagtttccatgagagccccaaaggaactccccagcgaagctgcccctctgtccctggagccctggaacacaccacgctgtgcctctgagcgccgtccctggggccgtgtgccttccaccatcctccctctgggccctgagcctttgcagactgagcagggttctgcatctgactctggctgaccggaggccttgaggcaagtcacccaacctcccagaactgcttcctcagcttgcaacagagtggtcagaacggagggccccttgggcccccttccattcagtgaaaagctttctgtgggtcctcctgagccccaggacagcccgtgagtgaagctgccatctctgcatctgggagtgtccttgtctgctctccaccaccctgcagccacagactccttacctgtctctcggcagagcaggaagatgcagcaggaggatggggcttctctgttttgctctcacaacccacgcctggcaggcagcaggtgccaaaccagcatcagcgtggatccag

SEQ ID NO: 26 - DNA, 2352 bp, Homo Sapiens
cgcccctgctgcggccgacgctccagtccctgcctctgtcctcacagggcctgctctgtgcatctgtctctattctgctctgctcttcatggaggaacaccagtgactgacttgggactcagcctcaatccagggtgacctcgtccccagatccttaattacatctgcaaagccctactaccagggaaggttgcattctgaggttctgggcggacatgaattttgggggcaggacactgtccagctcagtgccgggcgccgctgtgggccaggccctttgactcttgcaagcccacgatggctacagagctccaaggaggaggcttcctggaggaggcggcccagctcatcagagaaccagcatgtcttccccttgggttctgggaccagcacttttaacgataagtccttttggaccacgctgatccgggctgagacctgtcgcctgccgcgcgccttgggcggaggttagacaggccgcgcacctccaagctttgacacgtccttcctccaaagggtggaggccccacagggtgagtgcaggttggggatgggccgtggggttgccgggaggggaccagtgggggcttgcagtgttctcgggagggcccggggctgggggcaaccgagacctgcttcggtgggtgagtggagaagcatctggggggtttccttcagcgctggagagaaatgggtgatgaagcctgggaaaggcgtggggggcccgaagcgtgcaccacggtgagaaggctgcgcgtggtcggattccagctcccccgcgtctgcgaaaggctgagctgcgccggccgggggagggtcggaggctgccgggggttgggggatgaagagccgggggcagtttagggcagcgcatcctccgcggaggcaggaacggcaggcggtgcgattcccaccaggacctctgccatcggaaccgcgggtttctgccgggccggaggcgcctgagagatctccgcggaacggcgcgtgaacctgcggccgcggcggcgggtccggatggagatggacgctggatgggctgtttcctgagtttggttcccgtggcggggtcggcccctcgcccctgcatttggcagacctgatgcggagcccgagggtggctgttggcctggggcggggaaggggctctctagatcgggggtcccacctgctgggcttggggagcccatttggccttctctgattggtctggagttgcaggtgaggccacctcaggaagctgctgtatctgagggagcccgggccgccctgggggacgctggggtttgacttctggggctgggggctgcacgggtgggtcggggtctgtctgggttggggtccgcggccgcgtggggtctggattggcgtctgcctggcttgggggtcctcagccgcatgcagtttgggtcgaggtcgggggtccgcggccgcgtggggtctgggtcggggtctgcctggcttgggggtcctcagccgcatgcagttcgggtcgaggtctgcagctgcgtggggtccggctctcatggcccctgtgcctggacttcgctctccaaccatttcctctgcacgtttccctggaaaaggacatggggttcagggtggtggatgtggacaccccctgaaacccaccagccctggtctgtgatgcctggatggaggggccacagccacgccggctcccagcctcttcccagacaccctagcccctggaggcagggtccccccgtgaggcgtatcatccctgagcgccccacacgcctgctcctgggcatcctcctgggtggtggtgtggtgcggctctgcgtccccacccaaacctcacatggaaatggagtctgcagtgtgacggtggggcctggtggggagtgactgggtagcaggggcggatttctcgtgaatggcttggccccgtccctcctggtgctgtcctcgagattgtgagtggccatttaactgtgtcccgcacctgctctgtctttctcgttcccgctcacgccatgtgagacacctgctcccgcttcgccttccaccacggttggaagcttcctggggcctctccagaagcagaaacacctgtgctttccatatagcctacaaagcgtgagccaatcaaactcttttctctataaattacccagtctcagggttttttttgtttgtttgtttgtttgttttggtggaggcgggggtggacagcgtctctctctgtcgcccaggagggagtgcagtggggcgatctcagctcaatgcaccctctgctcctgggttgaagtgattctcctgcctcagcctcctgagtagctgggattacagttatgtgccaccatgcctggctaatttttatacttt

SEQ ID NO: 27 - DNA, 2470 bp, Homo Sapiens
aaaaccaaccgttattttaaaatgtactgccctgatattctgctgctgaggtaggtggtgatatgtagaaattaatttttcttttaaaacgaaaaaataatgcatttattaatatgcttttcccaaaattcggggaaaattcccaaatcggagaaaaaaatttaacatcagcatctactacacaaagcattaaaaacatttttcagcagttttgcttaagtatcttaggtcagtggtagcatgttagccaaaatgtaatccaaaatgaatgaacaacagtcagctggtagacactgtatgtaatacaatacggaaatatattggaagtatttcaaaattcaacatttgaatccgtgaatgtctaaatcaagtactctaaatcaggcgtctacttttgaaacaatacttcaaaatacgtgttggtggcaagaccgccagccatctgtaggaaatctttttaatggttcaaaattcctaggtctcagaaggggcgactgattaggctaaatttatatctcccggccccgtagttgtcagcccaggtagcgaatttaaaacactgggggtggatgagtagtttgaagttcagatcaaggagtgaaaaaggctgatgcttagaagcgccggctcttccccattcgcgcactcgagaggtcacggcgtagtaaagtttggtttcactagcgggcttggacgctcgcgaccaaagtctcccaagaaaagccgacaccgcggtcgggagcgcccggaagctcagcaggacacgtttccactgcagggaggagggtgtctgtggcggttctggcgtggagccccttcccccccccccgtaggaccctgcacccggacggggacaggcttcgccagctaaggcggcgggagacgcgtaggccacaaggaggaaatgggacagagtgcgacagagaggcggcggcggcccagggccgggccgagcctccctcgcggggcagcgagagggaaaggggccctcccggccgcagcctcccccacttcgagaggtagctccaactttcctcccagcgcacgacgtcgcacgggccgcgcgagattccgaaactttgtcagccctcgcgtcgccctaggcccgctccagcgctctgcgccggccgctaaccctcgtctctcccagacagctgcccaagcccatccaccccgcgggtcgaccagtgtttacctcagaccgaggtcgaggcgctcggtccggccgcggccccacagtaggttcccaggtcccagtcactccgctgccaagttccccaacatggactccttcgtccgctttgtggtgttacagggtctctaggacactgactccgctggctcggtccggaggcggcggcgaagcagggagcgacccaggttgcgctgctccgcgcggcttaagccaccgctactcccccttcccccgccttgtctagcctcctccctcccctcccctccctgcgcgtctccctcctcctcccttccctcgctgtcggcgcgctaaggtgacgacggcggcagccggactcgccacattctgcttactcgctcgctctggccctgagtgcatgttcgtagtacccagttgggccgcaggggggcgctggcaaactgctgtttgagaccgagaagcgtggtgggtggagtcacgtcacgcggcctgtgagcgggaggaagggcagctgcgctggaggggccttctgggaaacgtccttccagcaccgcccttcgcccacactgcggatggtgcgcatgcgcagcgcgtggactttggcctctgccctcctttggcagttttacaggctgcgtcgcggaggacaatgaaagaggctttaagggaactggacaggaaggattttgcgcagggtgtgctccttatctttatggtaatctgatattgaaaagagtgtccgcatgtttgcggtggattgagtgttcacctggctgcgctgcccacctgaaatgcagcctgtggagtgaagagtcggcaatttggaagcccacctttcctcctttctggtgggcatttttttagatgccagggggagagctttcccgcctgactccccgagcctaggggctttcccatgtcttaaccccacatcacaaaattaaatttgggccaggtgcgcggtggctcacgccggtaatcccagcgctttgggaggccgaggctggcggatcgcttgagctcagcagttcgagaccagcttgagcgacgtattaagatctcgtttctacaaaaaataaaattaaccggccgtggtggcgcgcacctgcggtcccagctcctcgggaagatgaggtgggagaatcgcttgaacccgggaggcggaggttgcagtgagccgagatcgttccactgcactccagcctgggcgacagagcgagaccctgtctcaaacaacaacaaaaactttatcattatttacttaaaaggcctccgcgttgtggttagatagtgacg

SEQ ID NO: 28 - DNA, 2305 bp, Homo Sapiens
ttgagaaactgccacagccacaagaggcatataaggagacatcataactaaatgtaatgtggtattctggatggaatcctggaacagaaaaagggtattaggtaaaaccgaaggaaatctgaataaaatgtgaaccttagttaataacagtgtaaaatattggttcattaattgcaacaaatgtaccatattagcatgagatgttaataataggggaaactggatgctgggtatatggcattatctcaatttaaataaactacattaagaaaataatatctatttttaaaggtgtagtgaataaaacaatggccacccatatatttaacacccggtttaataatggtcaatacagttaaagcctccctttattgtcccctccttaccagatatgactgcttttctcaacttgattttcattctcttgtatttcttgacttctttaactacatatgtatgcataactaagcaatatatagcattgttttacaagttttagagttgaatgtatatgaattgtcatactatttatttttctacatctttctctttttgcctcatcacatttctgagttcagtcttcttttattggcgtataatactacatcctaacatcccataaggtatttattctgttattgatggacgtttctaattttttgcttctacccacagcgctgttacgtacatccttgttcacttaccaaagtttctacaagacatataggtaggagcagagtgctggggtttagtaattgaaaacttttactagattttgccacattgctttcccaaagaggttttaacatttgcgcacctactagcaggtgcgtatgtttagacgtgtggaggagaaactatttaaagacatacaaactagataatatacttgcttcattctcgtttgaccttcgtacccaagcaattatttctgcaaacaaacaaataaacaactactaatagcacttcccgcaccgccagccgcagttttccctgcggagacgcggatacaaggcagcttccggcgaaggcggtgacgcaaaggatggcgtaagcacgctcgggacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccaggtagggcctacgcgtggctcccgggcgctaggtgttcgacagacttgaaccgcgaccttgtggcctcagaggtcgttcattgggaccgtggggagactctctaacctgtttgaggtccattggcatgggcgggttaaaccatgttctgccagacggggagcagcgtgcgccgggtcgggtctgggccgtgggctgagaaccggactgcgatgttgcggccctgcggggggacatttgcgagaaagacgagactgagtcgcttggggtgaggcgactcgagttaatctttaaaagacttcgttttatgttcccgtggctgcatctccggtactgtgggtggcccctctcacataggctgtgtgggggccgcgtggcctgatgcctttctaactcctttcagtgtggcttttttattccaaatcttgcgatgatgttgggtgaggacttaaggggtagtaggaatgggtttaaagtcaggcgtcggctttaatcttctgtgaagcctacaggtgtgaaaacccgggctctcggtcggagagtgggtcccggagtcgtcctgggtgatgaaccctcactgcccttagttaatgcataagacgatttccgactgtttttaaaattttgaccccacatggtgatcggacgaagggaaagtgttttgaggttgcaacaccaatatttgcaccaagaggagatactgttttgcgaattctagggcagcatgctttgagtgaagggaaacatttagccatagttcatcattttgtctagtttgtggacgtcaacagagtcgagcaaactgcaggttgctctttatggtggatcctagttgccatgattttaatactcttacaaactgtaaagcatcgttttgaaaagtgccttcagttttaagtgtatggggtccatgcttaaaatggattccaaactcagaaagatggatctagtggaggattatgggctc

SEQ ID NO: 29 - DNA, 2234 bp, Homo Sapiens
ccacttgctaccttgtctgccttgtctgcatggcaggccagtccctgcttccagagtggagactcgaagcatttaaaaagcccactcattctcttccttttcttcccagctagagaagagtgactgccccatctcctgcccttgtctttatacctccggacattcagggagcctggtggcggggaggtgtgttcccaggcgccctgctctcagttcccttgcggggtctgcaccagacttggaaaaaataggccccagggtggggaggggcaggacttgaggtggtcgtggctgggagtttgagctagtgtggactgtgctaatgtttttgcagtagcctggtctgttaccctctgagagccacacagcgggtaggagtcatctctatccgagtttttctcttttttcattttgccacaagacagaattgtatcacacatctccaaaacgagtaaaatggcatttcagcttcttgtctttatagactctctgaactttaggaaagatcattctggtcccttttcattaataatgaaaaccagggggcaataaaatgttcttaacgtgagcatggcaggaatgaggagcggtgaggggtgaagggtgaggctgcagggaccacaggtgtttcttggggctggaatagctcagaactctggaaagtgaggcagctattgggagggtcctggtcctcaacccacacagccagcgtctgctcagccttgacagcccagagggccccagagaaggctgtccttctcatggcgggatgtttgcgggtgagcagaggaatccagcaaactccaggtgctggtcaagctttcagccaagtcacagctgctttcttgcaagaggcttcatggtgtctgagaaatcagtggtgaatatggtattcgggccgtgggccccgttctgcacttgttctgcctgaggattttggctgcagggagggatgttccgggtatggatgaaggccctcctgagcagggactctgagagagcggggtggccaggttgctctgtcttcactttttcctcctgaaaatggacttgcactagatgtcaggttttgtatctggagcgccaagcaaagctggctagaagaggggagacagaagagacacctgaccaggactccaagtgcccggctccttggggtcgaggtgaaagatccgtctgcctcagtgctcttagagctccctgtataacgagaggtgatttgtgtcgggtgggggtgtccaccatcagtgaagtagcactgtccccttcccatggcagtttcttagacaccgagtgtcactgcacagcctgggaagggagtgggggaagtccttgctaaccataacacaaaccccagaacccataaaagaatagattgataaatttgtataaaaacctctgcatgcgacaaaacaccattagcagagtcaaaagaaaaataaaccagagaagatgtttgcgatgcagatcacagacagcgggctaatatccctgctatataaaaagtctctctaaagtgacaagggaaaagaaatcaagtagaaaagtggagagcatacagtacaccgaaaaggaaatgctgatgaaaacatgctcaatcctcactcaaaatgagatcaatgcaaattagaactagagtgaacttctgttttcctgctgtggtattggcaggaatctctgcgtttgaatcgtgcattgtgtgggcgcagccgtggggaagcaggcattgcgcagcggctcagggtgaattatcggccccatggaggcagggtggcagtatttctcaaaactgcaaatgcacacgccctgggaccaccctctgggggttctgaggctcacagggtgcgtgtccccatgtgggagatggcacgtgtgcacgttgttgatggcagcgtggtgtgcagtagtagaaagttggaaatgagctgggtgcccatcggagggcaggtgaagtggaatatcctgcagctgtagaaaacaagattgagagatggggaaacgtgaaggaagagaagacatcctgtgccaccttaggtgtgcacacagactcactggaaggataaatgtaagactactaatggctgttggtggtggggaagccttttttcacagactgccctgtgctattcgatgagtaaactgtatgcgtgctacctgttcaaaaagtgtaaaacagaaatgggagttggggactgagggagaggccctatgttgattacagttttgggaccgag

SEQ ID NO: 30 - DNA, 2317 bp, Homo Sapiens
tcacctggcctcctgccctggggtctccaaggagcaagggaaagttgtggccttcggcctgtgcctggctggtggctttacattcccctacttgaggctgatctcctacttgaggctgatctgctacttgaggtgggaaggggcacctggagccttcagctgcagggtgagagatacccagtggccccatttttcagtctccagagccacaggccaggagcggagggccaaggctggcgaaaaaacctggccatgtggacgggccaaagaccaggggtcgctgcgaaggtgaggacagaaaagcgctgcagaggcccccagactatggctccgtctccgccagagagctttaggggcctcagtggctcccttagtgctgtgtatacacgaggaaaggctagagaatgagagggacacagcacctctccatcccccaagtctgcacggggagaagcggctgtgagcctcagcaccagggaaacgcagcgctggggcctgggcaggactgatcgctccagcctttatctcagctgtaacttcccagtcgaacagggctcgcttcggcgggccagggctctcgcctttgctgaagaattctggctcaggaaagatggagaggctgggggttgaggagagaggaaaaaatggcaggggaggattggaggtgaccgagcgtcgagttttcacatctttattattgttgttgttgttgttattattattattattatcatcatcatcatcatcatcatcatcgaagtatttcacgtccagagctaagacaagactacaaacacaacacatagaaaattaataaaatagaactttgttttcttctgaggctcctcttcttacttctaggtagtatgtgctccttccagtggctttggggagggggtgggagagacgacaggtctgggatcagggagtcttcaaggcccccgctgaggggacagcgaatctaccattgaaccgtgcacgggggacatggacaaaatgagacgcgacagggacaagagcattttgctctgcttccaggaaacatcaagtgagtccgctcctcagttctcaccaggaagcctgatcaggctgaggcgagttcctcgggaaggaagggcgcgcgggatgctgggtgggctcgagtagtgaggcctcagagcacccgccgggagctgtgcgggcgggggcgtccaggagagcgctgggccccgcctgtctgcgccggagagcaggtctcctggctcccccacccgagagccttccttcccgggtctctctgacgccctcggctccccacaggcctttcccctcgcgtcctccctccctttccagcaccttcactcggcctgtttttcttcctcctcctcggcactgagctgagacgcgctgagcagtttgctctcctttttccacttcatgcgtcggttctggaaccatatcttgatctgcctctccgtcaggcacagggcgtgcgcgatctcgatgcgccgccgccgcgtcaggtagcgattgtagtgaaactccttctccagctccagcgtctggtaacgtgtgtatgtctggcggcctcgccggccgctgggcccaaaggaggaacctgttacgcagagtggagatgctgaggcctgcggtcaccgggcccaggaccccctcccctagtcgaccctcgaacacagactccagccagtaccgggatgccctctattctgccggctcccttcccccgtttcgcactcctccagcgccccctccagattccctcctagtctcctaggcctgtgccgtctgtctagactctagatgggggaggggaggagcagtttgaactcccacctgagcctggggggaggggctggtcaggtgtgtctcttcctagttgcatcttgtctttccctccctttccatccatcttgttcccaccccccgtcatccccccaacccaatgataaatccaggccgttaatccgtaatgacgtagatcgatccatagtccacattaacggctcctcactttcgagtccggctaatggacatcagttgggacttaaggccaacaaataatccaacctgagaccccgcgcctgtttctccctctctcgctccgcctgctccctctctcttccttccccttattcctcctccctcctctgactaccacccctttcctggtgcctcatcttgccccagctccccacccacagggaaacacagtcccagacagactcaactctttctcttcagcgtcaccccctacccccttgcatgacgcactccgtttttaatggagccgtctttggttggggaaccctaccagggc

SEQ ID NO: 31 - DNA, 2553 bp, Homo Sapiens
ctggccacccctgccctcccttagacctccagagcccccagtgtagccacagaggatgctgttggcttcagccccaagaagacgccgcttcctccagagggctaagtaagtgggaatccccctccctacttgtcctgggctccaggcagggcccctggtgtaaggcctggggctggaagccgacccacctaggtccaggctctggggcagaactgaaactccttggttactgtcggctgcagcctgggagcaggccactgccaaagctgtgggtccttccaggacagtctccccatgaggccggtcctccacctgctgtttcttcacacctggtggccagggatgtggccctgggtagaacgatgattctccactcctgtcattatggaagccaccgctgtctcccagcccagccagccacctgggctgcagagcacccctttcatgccctccgggtgcctcccccttctcctgccccagcctggctttgtcctaccctgctctcagggaggggtaccctggagtggggccagggcatggctctcccccgagggagttcctctctggctgtccccagggcagctctgcacagcctcagtacctggcgcacctcccttgacatccttcttagggacagtcaggcactctgtgtggggcactcaagagagccaggcccgtcagcctctagctcctgccagaatgcaggcctgaggggtgaggggcggggcaggggcagggacaggaactccggcgtgctctccatccgcaaaggttcactgaggccccgagccccagccactgagccaccaagtcagcctgggccaggcctgggtgccctgtctgcaatggaggcagagacggggtctcggggcagttctgaggatgctgggtgcacagcgggggcctcgccggcaggaatcacttatgctctctcctgggccaagctttgtggatgcccagcctggggccgcggggagctggcaggtcagtggcagacactggtgggcagacctagtgtctggtagaacaggcatcaaggaagtggtgaccggagggaagccaagtgcactcaaaccctcgggtgagtcatcaccgccgggtctttcacagctgctgaaagtgagcaacagtgatgaaggtttgtgagtttctgcgtgagcgagtgaatggaccagtagcagtttccaggttgtggaagagcgttccctccccgggatggggacacttggttacagcaattcctaatcccccacccacccaccgcccactgcagaggtatgcgggggccctgcttcctgcaggcaggagtgaggggcactcctgtgatgtggcacccctgtgaccgaggtcatgtgtgatcggtgtaagggcaggaagcgagtcattggtctgcaccaggcgtgggggcttctgcgagggcaggacccaaagtcggcctggcctcccggctgcagcactcctttccctttcgaattaggttagagccctgggacgggaggtgccctgtagaccacccccctcaccaacttccgtcctccgccccacccccgcggtgatccggtgaactgccggccccctgctgtgcaccgagtggggcagtgaccctgacgtggcgtctcctgccgcccctgccaccgccaccacctccggtggcccagcctccgcattccccacccccatggaggaatgcaccaggcctcccttcctggatgcacccctcacccacatgcttccaaaccctggcattttctgctccccctttactcccaccccttcccctaggctcccagacaaaggggaagtggctggatcctcttaaagggacagtgtcccaccagcttactgctgaactcccctcctcaaccccagttccctagttacagttaattagcattagcagacagcccatgagtgatacccatgcaggccccaggctgtggagagtttcctgggtaggaaacagcccttaaggtccctcatctcatccaggtcccagtctttcctacctgcctctctcctagattgtggccctttggagcctggttcttctgtccctgtgtgaccgacacatagcacccaaacagtggcagagcgggacggaccccctagcctgttctctgtgtgggtctgtaccctgacccagacatgcccccccacagcaggacccaggggggcacatgtgtgcctgcgggttcactggggcacccgcatttggtttattttattttttagagagagggtcttgctgtgtcacccagctggagtgcagtggtgtaatcatagcacactgcagccttcaactcctgggctcaagcgatcctccctccccagcctccctagtagctgggagtacaggacccactgtatcctggctaattttttaataattttttaagagatggggtcttactgtgttgcccaggctggcctcaaacctctggcctcaagtgatcctcccaccttcgcctcctgaagtgctgagattacaggcatgagccaccatgcccatcccagactgacatttctatatttgttcatcctggctgggcaggg

SEQ ID NO: 32 - DNA, 2381 bp, Homo Sapiens
gcgaaacagtcaggccgctgctcctaggacgcggtgggcgcacgccctgcggggttcggcgagcggaggcgcgggggctggggcgtgcgccggcggcggccggcccgacgcggaccctttgggtccggggtggggacgcgggggcgtccacgccaacgccagccggctccgttcacttggcgcccgctccgcccgcgcggtccgtcggttgcgcaccgaacccagacaggcgccggccaagggcgcaggcgttcgcgccgggtcccagccatgccagcggcgacgcgccccggcgcgccgtcaggatggccgagcggtctaaggcgctgcgttcaggtcgcagtctcccctggaggcgtgggttcgaatcccactcctgacaagccgaccttttggcccgcccgccggagggcaacgcccatggcaaccctggagcacctttggccgcttcctgccttgagcccttgcccgctctccagactccagtccccttgaagcaagcctccaaaacgccgccgcttctcaggcacgtccgttcttcctgcccacccgccggctgtcgcagaaacagcccaggaccatgcgccagcgcccgcgaccctctaccaattgcccttcggacagacgccctccccaccacctcacacgccctcttccctggccccacacacagcgagcgaccgcgaccaccttccacgctcttccctgcctatctcctccgcccgccttctcctcactcgcccaaacagacacagcccagattcttcccctattcctccttttccctccttcctcccaccggcctccgcccaccgcccaccgccttgaatcgccgctgcgctgcccagaggcgtcctggcctgaacagcccgcccggtttcaccctccaacttctgaccgctgagcagcagcgagcgactcgctcgtggagccgcacacacgtctcccaccagaggcacgccatccaacatcctgtcctttcctccgacccctcggaccccggccgcgcattccattctgccgacaccctagccaggtcgccgatcccacctcgctacctgtgctcccttcccgctaacacctgcctgccggcccacctgcagcccggacgcctgccggccagaggcagcgggaaccctgcacacagcctggcaggcgagtccaaacccggaaagacagcccaagaggaatcacgagcggaagccctagatccccgtcacccgcccacaaacgcctggccccgccgggaccagctctgcgccacagcgcatccccacgcgggaagccgcggcctgggccgtcccagcaacacccagcgcgccttctccagggtcagccagctgcggctctgcctaagcgctcctccgctcctttctcgcgctccagcctccctaccagcccagggggccggaccccaagtgcgagccggtggcgtgggtcagagcgcaggagcgaggcgcccacggacctggtctgcgtttctgagccgcacgccacggctgcgagacccgttccccatcgccgcccccgctcgctgacacacccatcccgcctctcacctgctggtgacacaagtgagaaggctggccccacggtggtgaaaaaaaaaaaacaccttacgaaagaaagaaagaaagaaagaaagaaagaaagaaagaaagaaagaaagaaaggaagaaagaaagaaagaaacaacaaaaacaaaacacaaaaactctgggtctgtgccggggatccgcgctcagcaaggcccgccacagcaaatctgcccacacgggcattcgggcgcgggccacggccggtccttcccctggagaccccggcgggcagtctctcgaccctgggcggcagagaaagcgcaagatgggacgagtcggcctctctccctccgctctccctccgcgccccgcctcaggtccctcgacgtgacgagagcctccccttctgctcgccccatcgggccagcctctcgtggacgctgcaataggacggaggcccacggcaggcggtgaccagtgaacggcggctggtggcgagttccgctgtgccagcttccgttggcgtttgccatcggtgcatgggtggttcagtggtagaattctcgcctgccacgcgggaggcccgggttcgattcccggcccatgcagcacgccctcccattttggtgctgcagcagcaccaaggcgtagctgcgctcgcctctgccgcctccttacactcggggcgcgcgagcgagtccggcaccggctgcgctcccacgcgcgacggccctctgccctttcttccgtgcctctctcgactgacttagggatgagcctaccccccgcacccacacaccttggtgacaacaacccctccagacacgagagcgcgccagacac

SEQ ID NO: 33 - DNA, 2514 bp, Homo Sapiens
cccccactttctctctctctctctctctcacacacacacagacacacacacacacacacacacactcacactcactgttgggtttcttgggctgctaacaggattaaatgaatgtcttggttccatgatgtgcatgttacgctagagagctaagttagttaacatcgctcattgggatagaaggaacgtactgaggaacgtactgaggattagaagtcagaattcttgaatctgcaaatctttttttttttttttttttttttttgagacagagtcttgctcttgttgcccaggctggagtgctcactgtaacctctgcctcccgagttcaagcgattctcctgcctcagcctcctgagaagctgggattacaggcatgctaattttttgtatttttaatagagacagggtttcaccatgttggccaggctggtctcaaactcctgacctcaggtgatccaccagcctcggcctcccacagtgctgggattacaggtgtgagccaccgtgcccggcctgcaaatcttctattttgttcagacactaactccagccctataaatagtcatccaatacttccagtaaatggtgcgcctcatattgatctgcctggttgccttaccgtgtttgttacattgctgtgtaacgagttacccacaaacttagcagcgaaaacagcagacatctattatctcacacagctgcggagggtcaggaatccaggagtggcttagcgggcgattctgggtgtcacgtggagtcacatggggtcaatgtgttggccggggatgcagtcacctgaagccttgtggggggaaggaggggctcccccaggcctgggaaggctgcggctgccccatcacgctctctcctccaccaggttcacaggttcacagaagtaaaggctgagcatgtcaggactgagctgagcggttcccacctctcagtccacagtttcccacagagcacgcaggggccgcaccagggctgggacggggctgcgaccaggctaggggagcatcctgggcaaaccctgctggggacaggttcgttgtgtctgatgccgtgggagatgcacgagcagtgactttcactttatcccactgtggccccgtgaccctgagcgagaatgcactggccgggcctccagggggcgctcccttaggaacaccccatccccgtccccgtgtgctgtcgagggcctctagcgggcgctcccttgataacaccccacccccgtcgctgttgttgtcgggggcctcccgcgccccaggaggtttcccagggcgatgctctggtccctgggtcctttgatctcatctccctagtttagcctttgaactccatttcagattgagaggtttcaggctggagtgacatggagggacgtgcctgacttctggaggataagaggcggcccaccccacagctcttccagcgtgggagctctgaacatgggacccggagcaccaccgtttagcaaaccttgctgcagtttggagagagtgtcgcgggcgcctggcctgtccggcaggctgggtggctgttctctgttgagcccacagccatgccccacatgcaggacgtttgcctatcacttggaggcctttcagggatcttgctagcccacggctgagcacagggtagacctcaccaactcacccacaacctggccccttgacacactggtgctgtgaggaggaagatgtgggcactcttaggtccctggtcctaggggtctgtgctggggtggggctcgttgacctgcatcctggctggccctgtgactctgcctgtttacagtgagcagctcctggccaaaagctgcttattggattagccggtgccccgacggcagagcccgcagctgtgcgcaggaggacgaacctgtgtgtatgtcctgcttcagcgcgctcctggggtcccttgagttggtctctgtgactagaaggacagtgctggccacgcaggtggcaccctgggggtgcccagcacccacttcctgctgagcagatgctctgggtggcaacggcccctgccaagcctgggcagctcaggccaggtcctaatccctccgcttgagctcggctcctcaccctttggccaggctgacacctgctccccgcaggtccttctcgccggcttcaggcagcacaggaccgagggctgaagatgctgagcagctacccggcctgcctcttctcagggatctgtgtggccctgctggcggtggctttggcctattacttctactggtgagtgaggccggggcccgggggcctgggcagtcctgggggcctttactgtgtgctcccctcctcttccagccctggaccgttctctgcatgtcaacaaaccctgcctagccctttgcaggggaactcctgggaggtagggaagcaggggatggcaggaactcattctgatccctcctggggtccttgggcagctctcccatccttctgcaaaggggtttttgttcagaacattcctgaaggagctgagcggtttcat

SEQ ID NO: 34 - DNA, 2325 bp, Homo Sapiens
agccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggtagggcggggtcttggggcacctgcgctccgcgcctttcgcgctcctggagcaaactttccacctccagtggaggaagtgggagcccggggacagggtgaagagagaggacgggcttttagtgtaaccgtagagtcagccacagaagttccacgaaagtggaagttagtttgccagcttctccactcagcctggtgcgttttactcctagtagtaggtgctcgagtattgccttattaatactggggccttagggacctcgaacgtcacggcggataaaccagaggttaactgcttgggatttggggtgggtgtgtttgaacctgtgtggcatccccgcgtcggggcggctaaagcgtcttgacgtttttggctaagcctgcgcgcttctccgcttggctcaaagggaggcgatcagatagtgcaagcccccatccctctttaatcctgtgacttcgcatcctgcgcatcgaagacctttatttgctttgcacgtctcttttcttccccgctaagcaaccacgtgccttgaaatgggaaagggatacagatgttcggctgggcttccccgggtgggtccctgaaatgcgtcctggttagcacatggggtgggagcaccttgcccgagccttacctctctaccctctcttcgccggtccgcaggaggctctgacgccagccaggtacccaatggcaagaggatgaggacggcgttcactagcacgcaactcctggagctggagagagaattctcttccaacatgtacctgtctcgactccggaggattgaaatcgccacttacctgaacctgtcggagaagcaggtgaaaatctggtttcagaaccgccgagtgaagcacaagaaggaggggaagggcacgcagaggaacagtcacgcgggctgcaagtgcgtcgggagccaggtgcactacgcgcgctccgaggatgaggactccctgtcgccggcctcagccaacgatgacaaggagatttcccccttatgagggagggcctcctccctcacatcccccgctcctggcagaccaggcaacgccaaggcgtggggcacccaggggccagaatccttgctcattgcagtggtcccatctggagaagaaacgaacctggaagttctggaatggacaagccgggacctgacccttcgcgtctccttcttgacctgtttatctaggactccaacttgaagttacagatttttttaaaaaatgtaaataacctataattcaactcattcttgtcgtataacagaggaaaaacagggttggtttaagtttaacactgtatggggtttttgaaagcacatgtcagttccccatccctactctctttcagaactcgataagaacacaggatttattgattattttctgttgtcgttttcaaacaaaaacacccaagttgaaaataatttagaaaattagaccttgtaggtcttgctttctgaaatttcgcctggggagaatttaaaatctaagtcgctggaagtccctttgtatgtgaataggtttatataaaatttatatttatatttatttaaataaatgaaacaaaaaccagaattttaaatctgtggtgtttgctctccctatcttctcctgccccctcctccaatgtctagagaaaggcatatgcaggaaaaagctgtctgaggaattcgaggaaaatgttgagtaagaacttggtaatgtgggtctcttgactgagggagtttgtggctcaatgggttttctatgtaacagaactttcgccaaggagacacctttagtcatgatggcatctaccaggcagtgcctctccatccttaaaataggcaacctcctcacagttgataggacaaatcactccatttggaatgacactgaccattaacgacaggtaaacctttatttagcaaggaagggtaaaaatcccccatctagtttttgttttcttctttctacttcctcatttctctcagtacgaaaacttgaattatgtgaaggaatttgtagagtcagaatagttttaggaagagcaacaatccatcaaacaggtcagaagcaaacagtggaaacttaataacgatgctacaagcagaattagcgggtttccctcaatgttaagaaaacaaaaagtcagggacaggaagtattctgttcaaagatttat

SEQ ID NO: 35 - DNA, 2541 bp, Homo Sapiens
aatctagctctatagttcacatcttactctaaaatacagtccaattgggttaaaaataaatacttgaaaatcaaatataagaagaaaacattaaattattagaaaatattggtaaatattgagttatacaaacctgacactgtcaaaacacccaacaagtaacaaaccacgataattgtgtaaggcttaagtttgtgtgtgtgtgtgtgtgtgtctgtgtgtgcatgcgtgtgtttatctgcagggtaaaagcctagaagaatttacactgaaatgttgaaagttactgggtaaagggttttgggtttcagaggtttttgacgactgtaattattttgttttcttaactgaatgttctttttttatattgtacatgattacttctgaaaaaaaaaaataaaagagtatgtcgttccccccctgcagggaggcagagtccaggtggccaccaaggggctgttgtcacagtccagggaaagccagaatggcaggcacgggagccttgggaggggcctcaatcaggcttgccctttggccccagaaagagcaggggcctgcagtgaagcccatagagccccttgtgggccgtatgggccgcctccaggcctccacctcctcccccagtcatggccgctcagtgtcctttcacttggtggtgtggggacactgggaggcttcctgggcctcccaaccctcctacccaattcccagcccaggcttggctctccaggacccagcttctagtccctgtgaggctgggccaccctgcaggactgcagctctgggccctctgttctggtgctagggccctggggcccatgaatgcagttctagcactcgggaggctgaggcgggagaatcacttgaacccgggaggcggaggttgcagtgagccgagatcgtgccactgcactccagcctgggcgacagagcgagactctgtctcaaacaaacaaacaaacaaacagcagccaacattctccgagggtttcctagggccaggcgcggggcagtctcatgtaattctcaagcaatcttgggaggcaggcactactgttcattgcccctcccgattttagagacaagaaactaagattcagaacacaagaaacttgcccaaggtcaaggagaagtggaggcgtggggaggaaacaaagtcacctgacaccagagcccatgcctccaaactccaagtctgggactcctgattaaattccgtctctgtctgcactttgggaagattctttcctctcctaggcaagtgcccgcggggcctgagctctcgatagcggggccccaggagccacgttgtggggtctgctatccggcctccctctgcacgcgcgaccgtccacttgagcgcagtggctggagctgggactccagcgcagcccctgagcgctcacgtcgacccctccaatcacaagaggccctcgtgccaggcccccagatttggccaatcagggaagacctttccctgtcacagaatggggtcgaggggcccaggaaacaggtagtccccagtcacaaatcatcgcgtcgccttcgctggtccctttctcttatcgagcctcagttttctcttccataagccgggccagcagtgcccaccccacaggttggcgccagctccgtaagggccctaccaccgcggccggccagatcctcggcgggccagtcctggcgctgcggtcatttagcctgatgacccctggccaggttcagcctcaattgctccaaagaactccggacccgtaccccgagcccggcgtcccagcggcgaagttgatgggccccgcaggagcccttgcggtgagaaccgagtcctggagcccctggagcccccggagcccccggagctgcagccggggcagcctcctttccgccgggagtccagcgctctcgagagcccagaaactcaccgcgcgcaggagttggtgcgggcgtcccgggcaggttagacttctgtgagccgcagccccgaaactgaggttggtgcagacccgtcctgggagccaggaggtgggacctgtccccgccagtccgcgagctctggttaaggccagagcccgtgaggggaggggcgcggggcgggcggagagtcagccgagtgggggcggcgctcaccggtggtgggactatggcgggagcgcagcgcaccctctccgggcgggtctataaatgccatgtaaaagccaaccccgcaggggcctgcgctctttcccgcttaggtcaagaagacttactgtggacccttggagaattcccagggctttgaaaagtcccaagcacccagcagggctggcagttctgagcgctggcaaggctaagtgggtcagaggagaccctcgccaagccggtgactcactcactcgctcaccctctctcactcttgatgggccaagtacctgccatgtgctacggacacagcagagcgaaaggagacgctgccctccgggaatttgcagccgcttgcagaggcggccccttagcagctgcgcatccgggtggatagcggcgcttctgcccgcccagtgccta

SEQ ID NO: 36 - DNA, 2501 bp, Homo Sapiens
tttgcaaatggagacatcttcattattcctatagtatcatatgtttttaaagtttgtactcacactttgggtgataaatgaaggacaagatccttccctatccttgtgaggatgactacagcatgactggatgggcttgctatgatttttatctttccctgtgttctcactaccgttttattaatctcagttctttttcacagggtagcacagaatttaactagcagaaagagatccagccatgtagaccagagatttgtctaagtgacggcatgtaagaatcaggaaggaaagttttttgtttaaataccaacaggttccttccttaaagcaattattatttttcaaatctaacccacaaggtgatagtatccttaaaccaattaaatcagaatctcgggttggataacctcaaatatgacttattagcacttcccattaatcactggtccttcaggcctttaagtttacttactaggaatctcacttttaataccatcttatcaacttcagttgtaaataagagaacactcaaaggctgaggaattctcagcggtaaagctctgcccacgttaagtaacaaaggataagttagtctttgttgtgatcactttgttgtactgataagctacgtatttctactcaaggattcaaattctcacctttctcaagaattgggccaaaaccgataaactaaacttatttacggtccactgattaaaggttgttgcataataagttcttgctatgttcagcagttggattcacagcgccagaaacctataactgcttgactttcctccccactacactgcgaaaattgccccttaaatgtaactaaccctaaaacctcaacagtatcgtggccaggcgtggtggctcactactgtaataccaacattaggcataggcgaggggattgaggccaggatatcgaaactagcctgggaaacacacggagacccggtctttggaaaaataattagccttgcgtggtggtgggcgcgaggttccggctaatcgggaggctacagtgagccatgatgacactgcactacagtctgcgcgacggcccatgtcagtaagctctggagcacctgaaacaagttgtgttgggtattttatttactggagagcgattagtgactgatgcctacttacagcgactagagacgcatgctccgatagcagcacaaactcagcaggcgcgaacaaatggtaaagagaaactgggcaaacaagcatcacggctcctcagctgagaaagtgggggccctaaaaagggccttttgttgatagaaagggacgctcaaccaccgaaaccgtagagggtgcggccctggcgcttgagcgcgtagaccacatccatggcggtgaccgtcttgcgcttggcgtgctctgtataggtcacggcgtcccggatcacgttctccaggaacaccttcagcaccccgcgagtctcctcgtagatgaggccggagatgcgcttcacgccgccgcggcgagcaaggcgccggatggccggcttggtgatgccctggatattgtcgcgcagtactttacggtggcgcttagcgccgcctttgccaagacccttcccgcctttgccgcggccagacatgacgagcaagaggagtctcacccaacgctttgtgaggactctggcctgaggcagcgcctttatacgacagttggcggaccgaactgagaacctgaaagaagtcggcgggaagtcccgccccggtgggggaggggaaatctaaagggccaaaccgaaatagggggaaaaaaaaagcgagcttcttgtttccgtgttctgaattttgtaacgtgcatagtattttgttaccacgttatgaggctttaaaaaattgcttttgaacgcagaagatatacatcaatactgtgggaaatacaagaaaggacaagaaattaagaaactacaatgttatcccatcacacaggctagttaatcatgtattttgcagagcagttgcacatatttttccaagaaaatgtatacagtgttgtatatggagttttgtaacctccttatattgattataatttaaccaatttctattaaagagataaaagtgatgttttggtgtctatgtttcttaggaattatcaatagttataatcagttccccagcaattttttaatcggctgtattttaaaaataatgttttccacattcaacataaatgtactttttctctatacttgggaccaatattgaaatttatgattttattacaccaaaatttaaattttattacattaatatttaaaattgtattagaggtctcatgatttggtactacgggtctccgcattatttcctttccaaatttcctaatctgtttcaccaaggtttctggacaactttagagaccttttgtgaagtttgaataaaatctcttcgagattttgataattgcattagctttaggacttaattggaatagaattaaaatccttaaaacaagctcttata

SEQ ID NO: 37 - DNA, 2257 bp, Homo Sapiens
cctgccccaagggccacggtgcccacaacaggacgggcatgggacggtgcacccgaggcccgagaccccaagaggccccgctaaggaatcggtcagtggagaaggggccatcagctccagggggcaggagagctagggagggcgcacagctgggctgaggtgggagtggtttcctccggaaaggcggggagggcggccctgtgctgacggtggaggctatcctggcccgctgcatcatggcccagccctgccccaggtctgtcggggcactggtgggacacaggcgaggtggggccctggctaagaactgtgaggcctgctcaccaggtgggtctcgcagtgccggcacccggccagggcagtcaggagagaggggaggacttggggtcctgcccccccggtctccaaggctggggtgctgctggctctcacgcacccacagaaaggccagggcgaggcagctggagcccccaaggaccccctttttgaagaccctttggagccggctccctggccccaccgtgagccaggccctccctctggaggccaagaccagagggctggacgtccactctggctccagtttggttcccaggccccacccgctcctcggctgcaggcgaaggtctccacctcggggctggcttccatggaaagagccctcagatcccagaaggtacagggagaagacgccaaccaatagctctgtatttgggcgcccctgaggtggggaacaggaaagcccgccgggcaggtcaggtgtgaaggcagaggccacgcacagcggccggccacacccgcctgtagctgcccggaaaccccaccgggacccaaggccgcaggtcctcaccaaacaggcccgccctttgcgcaggtcctcagggaacaggcctgccctttgtgcctcccctgggctcggctgagacaaccccccgcctgttgccacgctggcaacaccccgtcatcactcccgcccctcctcacaccgggctgatgtcggccgcggccctgagcagagtggacagggcagccttgctcctgcacgctgctcctggagccacagggccctgcccagccctccagcccctgttggaaaataacttttgtaaaaggtcactgccaggagcccccatccttcagcccacatgggcccctccagggcccacccttcccgccacactcagttactgtaagaaaagggccccagagggttcccgcctcaaaacctcggaggcaccgtgctgaggagggccgcgggcgggtccactggcccagcgccgcctcacttcctgggcccggcccagcccacgtcaccaaagggaccctcgccggtggccgagcgtggcgggggcccgcacggggtacagaggtcggagtcggtgtctgactctccctccgcaatgtagggcctgactttggcacaaggcgccacggccgcgtagcagctgttgagagcatccaggttctccttggactgggagatgctgaagccgctgaaggaacgctccagctcctcgtggtccacggacgggatggagatggacgtgtcgctgtcccgcaggttcccctcggggggcctgcagcccggggtgtcctcctgccgcaggaactccatgctggcgcggttgcccccgccgtaggcggacagcgaccgctcgtgggcaggcggcggcgggatgcgcaccagggagccgtggtcccccacgggggaggtgccgtggccctggcgcgggtggctctgtggctgccaggaggtggagggcggacactggacagggggcgcggccgggggcgccgagaagttcttctggcccgtggagctgctggagcgcacgatcttgacaatgcagccgtgcctgtcgacatgctcccggctgtcttccgggctgtggtacggcggcgccggctccggctctttggccccaaagtaggcctcggtctctgtcggggggatgcccatccgctgcatgtagatattcaccaggaagtccagcttcttctccatggacaagacctgcaaaaggggctgctgggctggggtgcgagggcccgtcccaggagatgtggggacccaggctgctcccaggaaatgggggggcccaggctggttccaggaaacaggagagacccaggctagtcccaggaaacgggggacccaggctagtcccaggagatgtggggacccgggctgctcccaggaaatgggggggcccaggctggttccaggaaacaggagagacccaggctagtcccagga

SEQ ID NO: 38 - DNA, 2434 bp, Homo Sapiens
  unsure (1598, 1841, 1846, 1848, 1869, 1871, 1873, 1874, 1878, 1880): unknown base
ggtcccgtagcacactttgggagctgcagacagtaaacctggagctccatagagcattccatctctccaccatctgtgggctaacaggctgtgttagtttcctagggctgttttacagtaccacagactgggcaccttcaacaacagaatgttactgtctcgcagtactggaggccatgagtccaagatcaaggtgtcagcagggtgggtcccttctgaggctgtgcaggaaggctctgttccaggcctgtctcctcatgcgtgggtggacatcttctccctgtgactcttcattaagggtgattctggtgagggctccaaagaggagacttggacagaatgttggtagataaatgtgtcagtggaaaccagagggtagacaggactccatccatgcccagggctttctggggacagacctgtccaagcagcaaccattcccaaccgagttctgtttctggaaagccaggcaacaggtggggctgggccctctgggatttgtttagtgacccgattatgtgggaggcctgcagtgggtggttgggtggggggtggtaccaatgccatcatgcccaacctcattgcatcactcacttcccaggccctgccctcaacccctcctgaccaggccctgtcctggttctcagccaccttgtcccagtgggtgcttcagcccactcactgaccaagtgagggactgactccaggttacaaagtgctgtgtttatgtgacctgagaatacgtgtgcgcagagtgttcccacagtgtccttgtaaagttgagcatgtacatgtcctgccagtgtgtaggcagcctgtccacacatgcctaggagtgtgactccatgtcctggtagatggggaaggagagagggagttgtgcccagggtcccccgattacttctatgggtgcatgtttgtgcttcttgttaggggtgcttggggaagattctgccctgggtgccctggatcacctgtgtgtgtgtgtgtgtgtgcacgcggggacgcgcacgtgcattagggggtgtactgtgttacagcatcctcaaccaactctgtatgtgtgcatatgtttgtgtgtgtgtgtcctacaggtgtgagcgagtggatgcttccactacgtgtctgcacatgtgtgtgtgcacttgcattgtccttgcacacctgcgtgtgtcccgtgagagcggagcccagcatgtgctggcacctgcaggaacatgtgagtgtgcgttctgtgggtccctgtcctgatggctctccacttgtcccgagtgtcacgacgacgaggatggggaccatatcttcggagcctgaggatccaacacaggtccagccctgtgcagccgcccgccaagccgccagaggacgagccggacgccgaaggctacgagtggacgattgcagttagtttccaactcgccgacttcgcgcccctccactggctccggcttgatgatcccggcttcggggtgctctcggtccctccccatcgcgtcgtcgctttctcccttggcataacccccagccgcggggccgcagaccctaagagctccatgagctctccgcgccctgcccaccggccccggccccgacccctnccccagaccggaccagagaggtgggaagtttgggggcacccgctgtgggtgtcccgtttccggggctgggctccggggagccggcgcggcgcccgctccctgcccgccagccctttgggagctcaggcgcgggcagccgcttgtgttcctgggaagggcggagctgcgtcccggggagacacgccttgcagccggcagcctagtcgctccccgctggccggccgctccgtgagggccccgcangcggnangggtcggggctggggcgggcntngnngagnangggggccccgggctggggccggttcggcctcccgggtggcgcgcgggccgaagaactaggaggaccgccgggccgggccgcttgtcctttggaaaaaccttggcggttcctcctctggtgtccgtggaccccgccgtggcgttctccagggccgcggacctttgcccaccggtcgcgccagctgtcctggagcagaaaggacccccctcctcccggaccgagccccgagccccgagccccatggagcaggcaagcgccggagtcccgaggctaaggcccggccggcgggcgctctggcaccttttcccgcccccgagggtgcctgtccggcccggccgggactggctgggaaaccgaggccggaagaggtcgcagtccagcaaggaatcggtttgtgtggggtgggggtgggatgggagacccctccccaaccccaccagccccagcccagctgtggcccccgccgtgtcactcagaaaaccagcgtcaaaccccagccctgcctgggatgtggaccttgcctggggagagtcccgttcaggcttttccagggc

SEQ ID NO: 39 - DNA, 2476 bp, Homo Sapiens
tgaccccaggccgacaactgcaagttcctaggcagaggggaagccccagcgccgagaagcccgctccgagaactccccgcgccgggcgcccagcctgagcgtcccgggcgcggagcccatccccggtgcgggcagggctccagccgcaggctcggcgcagggcggactcggccgaagcccggagggccggaggcgctgggacgcagcccggacaagagggcggacttgatctcggaaagtttgtgggactcaggcattttaacactgggaagacaaagagatccgatttccctgggactggtgaggggagcttggcggggaggggaacggcagggcagtcaagtgtgaaagagaatttcctgggttcaaagttaacgcagtcaccttataagccatcttagaggtgaccggaaaaaataataataataaaggtgtctagcaggttgtggctgggaaggaaaaataatgcctgcaagatgagtgtgccgattcgtagccctatattccctgcccaccagttggaatacacatagattcacacatccagcaaatgcaaactccatcatccaaagacgtgtttgtcccggccataattgctccaagtgcttacaggtcaatttcatacatggaacacctcgaaagtgggtgacctgatctccaagcccaaccggcttgtgccgcttgccgaattgtaaatctcagcaaaacccaaacacaccggaactccagccgtttcctgggagcgaggaagcgggagtaatgctaaaaggggaaaagaagaacagtaaaaaaagtacaaagataccattccctgacgtaaaatcacgggattttttttaaatggcacaagagaattcctggagaagattaccattaattaataagtaataacgcttcctagggcttactagatgttttacatctgtctgggaatcccgattttccaggctccctgagaaatctatctgcctggaagaagttgcacttcgtcgccacaggagccgccgagagccagggatggagatttcagacttaggactctgccacgattctactgatccttaagcgccaacagaacgaaatggacatgcctattagctaccacaaatcgaattattttatatgagagagagaaatgtggttcaagttccacatttgtcctttaaataatcgaccctccctaaccctgtccccaaaggctcgtggaaattagggagggggttggggagacggttccagaaacaaaacgctttcctccagcacggcctctacatccagtccacccaagctgatttttgtaactcatataaagaatgggcccgggtgggtggtcagtgaagactggggtgagcaagcgcccacgtcgccgagcgccggggaggtccaggttcgcctccgcacagaaccctgcaaggagcgcgcctcgccaggtgcccggactagagggcgctgcgcccctgcaaatctcgcggccccgatgcgccctccctaggcaccattgctataataagttacattcaaaataatgcacaaacagcatcgcctctcaagttctttttaacagtgctctatatgtattttatgaactcccaaagctatgcatacgaatctttcatcgccgatccgcacaaagccagagggatgcgcagctcctggagccgagaacccgtagggcgcacacgcttccccgcactcgcttagagccacacaccccacgtaatttcattaacgtttaaacttaaatgccaaaaggcatgcacgatttgaacaaagaactcaccagtctagccgagtcctcggccctgggctctaaagtcctcggcagctccgtgatcccctcgcggtgtagatatgtgttaagagccgggtttgaagtaccaactttgcctccccgggatcttcagcatgtccctaaccagagtgccaacgtccgtgccgccgggacccaggcggccgcatctccggaggcttccgaccagggcaaacttaagcaccaaacgcaggcgaaaagagagtgcgcggggccggaacgagggcccgggagcagccaagtttgtcaggacgtgcccaggcagccagccgccgagttgaggagttgcggccgccggctgcggcgactcgctgcctctttccccactccctcccccttggaggcggtgggggaggggaggtgacgtcagcgccccgcctcgccccccgccccgggcgcggacgggattctccggctgggcgcgccaccccgacagtggcagcagcggccgtggaggctgcgggggtcccggcctctgcggtctctctggccggccgcagctgtggcgcgggtgaaacgcccgccctcctccttcggctgcgtctcccgggcgccggcgagcgcgggcgttcctcgcactcagcgcctggagccgcctggagccccgctgcgcgcacttccccggctcgcggagcccctccggcggcgtttcccacgccgcggact

SEQ ID NO: 40 - DNA, 2520 bp, Homo Sapiens
gcccctggcgcgcagcgactcagagaccgtctacgaggccatccaggatgtgcacggcccgccgcgggaggagagcggggaacaggggtggcgcgctggggaccgcgcccgcacggagccggggcgcgaggagacctgctccgctcagcgtcgggcacgatgcccacctctgtctgaagacttggaatgagctccctctccccaaccgcgaaacgggagcggtgcaagcccctagtccctcatctgcgattcccaagctccaaagctgcctggaagcccagaagtttttcgtaatccaattggtggcaaaattgcgcttgaactgatgtgaggctgttgatggtctttatttgtcaaacttgtgtgaatattcatgttttgctgcagaaatgcaaatgagctcgatgaccggctgctgccccaagccctgctgggaggttatgtgacctacagcaggtgtgtgccccatagtctctttccaagtcccagctgttctgtattccgaagcgcatctgggcacggaacgggggattgcgggcttgccgccggctcaacagccttgccagtctcccaggagcctggggtcagatgagagggtggatgtgaaactcaggcgtctgcttccctttgagggtgcttccaacatttcagatgggtttgtttgggtgcttccaacattgatgggtttgtttcagaaaggcgtccggttatggtgaggttgttttttttctctcttcagaatccggttgtgttaatcagggaaatcgaaaataaagcacgttttaaaaacacgcttacatcctcagaacactctgggcgaccctgacattttgaactttaggaacttttcaaggaggggcagcccgagtgggaaaaagagatgctcagaaccgttctttcatctgccaccagctgtgtgatgatctaggggcagttcccttcctctctcagggtctcggtttgttctttagcccaaagggaggggatggacagatgaccgctgaaccttgggagcctctgatttctttcgctgtgcctgatgtcattaccatgaacactgatgcccaccatgtgccaggactgagtccgggatgcccaaacgaagagacacgcctccgtaggcccgctgctggatgttccctccgctcgactcgttacaatgcagagctcaggtttcgagactagggaaagggcaactggactctgctgggtcacctgccagttgctgacagccacttaacttacacgcgaggacgctcccccaggcccagcgtcctctggtgtaagcacaatacctaaggattagggttgtgagccctaaacgaggtaaggcttctaagcacttggcagcagcagggggtccacccagactgtccgggtcgtcctggtttggcttccttaggactgtgccgctttcactcgagctcctgcagcggcagcccgccgccttgtggccagggtggaaaacggcacccggcggacagggcaggagaccacggctgtttcctgtttcgcgcccctgccagccagcaggcagcttctctgggatggatggctggatgccagcgctcttcccccgcagcgcccctccgtttcctgcccaggctcccggtggcgcacttcccggcctctccacattctctgtcctgtaggagggttcctgcccgtctgagcggagcccctggaggtgggggaatggccttattctttgaacctcgcatccggcccagggtctggctcagacagagtgcacagagtgtgtgctgaggagggcgcaggtgcggcagccccttacctatgagccaggcctctgtaggtctgcccaagggccaccaccaggccccaggaccaaagaggaaggagactgcccaggtcctgacatctcctgagaagacagatgaccctggctgccagggcgcctgccaggtggcccctctgcccatccttcctccagctcccagcaggttcccagttgcagtggcatatggggggaggggcacaggtgatgagggcaggggacttacccggggggaactaggacattggccagagacaggctgctccttggccccacttgtggccctaattcactgtgtgacctccacaagtcactttgcatctctggtcctgtttcctaccctgtgcaatgtgctgttgcactccagcctggatgacagagcaagattctctctcttaaaaaaaaaatcttaattcagttctaattcacttctcgaggagagtcatgtatctggtaaccttggcattgttgcatgtaagagaaaaccagaaaggaagtgatagaggcttccaaaacactgtcacataaatgagctattaattgaatttttacaactggctaatgagctttagtatttagaatcaccgaattctatagagatgaactgctcttttaaaagatcatgtgtttttaaactcatgttcaatgagccgattatttcatgagggtgccaggtgacatagtgaagaccacatatgcacagagtgatagaacgctggcag

SEQ ID NO: 41 - DNA, 2555 bp, Homo Sapiens
aggacagaaatgagctgggaacctgggcagcccaccaccccctgcacccacagaggcgggactgcggactctggctgggcagacaccccagaggagcctgacagctccttagatgcggacagcaagtgctcactgtggcactggcctttctgtgctcctgggctcagagctcttctccctccttccctcctctttcgtaggaagtctcactacctaaaattgtctgtccaataatcaccaccaagatgttacttctgagggagcatacacagtaggtgctcaataaatacttaataaatgaaggcattccttgaatgatccactcattcagcaaggagttcctgggcacctactttgtaccaggtacttaactaggccctggagagaggaaattcaaggagcccaggcccaatgagactgacgcatacgctagtcacttaataaaaagcggtgcgtgcagtggaagaaggtgcctgggagcaaagaggaggcagcccttatcccagctgagtcctccagccaaggggctggggtctgcaagtacagggagcagtgcgtgcgggagtcaggggcccttagaaactgcttagaaactcgtgagggggccaggacgaagcccagagctagacattcatgtttagcaagtcagctggcccacaatctgcccctctcctgcatgaacttccaagggggtgcagatggagagtgtcagcgaccccgcgctccccacaggctgagtccaaatccccggggctatgaatggggcctgagaagccctgggggtgggactggtccatgcagactcccgcctttgcccttgtacctgtcagccagagccagggcctcagggtctgtgggggggatcacaaaacacacggccggagcaatcagcttgttcccagcgctgtccatgagctcccagctctccccgttgttcttctgcagggtgtagctgtagccccgcgagatcaggccctggcgggggcaggctggacagtcaggatcccggcagggcctgagggcctgggagcccggttgccatctcagcccccgactcttggacctggggagccccggctcatcacttggaccctccccgtagagtggggaggggcatgcaggagaagcacatgtgttgaggctgccggcccagcaacccacctccatttccctttggggaaccttccctcccaattcccagtccctgtggtctctccttctccattcccaagctccagatggacatgtgacttggacctggccaatgactggcattcgccagccacagtcattggtatagggtggaccctggcattccctggccacagtgattggtgtaggatggacacgtgactcacagtgagccaatgagaacctggcctgggacttctgaggagggactggggttgctaagctggtggaacacaaggccagggcagccgaggtgggggcggcataggggtgccagttggcctgcaccaggggaagggttggcagagtgacaccaaccacggagacaggcacaggctcctgagaacggcgcctgaggcccgggatccaaccatgttaccccaaaaactttgtagtgatgtgaacagaggagctggccccacgcacctgctccccctcaaagtcacagagtgcctccacggggatgggcttgagcggagtctcccggcggtacttgaggggcaccacctgctggcctcgcttctgcagcccctgcaccacgtcctcatacttgtccagcaccttctcctggtcctggagagaacggggtcaggggcccaggtgagaccaacagccttccccctggtgggaggacgcagagcaggggctggattcagcaggtggggtgctgtggaggggcctgtacagggctgagggcaggcatggtgtagaggggtcccccgccccccgggccagcaggggtcctgggccatcgctcacatccagctcccgcagcagcagctcaatctggtaccggtccttgaagtcagggccatacttctggttcaggtccgagtccaccttgcgcagcagctcctgagcgtccttcacgtcttcgtgaaactaggggagaaggtggctctgttacagccaggaaaccactagaagcacctgggcttctgtcggaggcttcaagctcatccctcaggcggggctgggcctccggttcacctggagtccagcatgggaccctgtgctgagcctgaggctcctctgcgtggagacagccccaccctccctgagctggctccttaggggcctcactgggaaaagccaggtcccttcccacccatccatgagatgccacctctgtgacatgttttcttggatgtatcagtaagtcttgaggtgtctttgattcagttcctctctctgtactaggaacatccagacttaatactatagcttctttctaggttttgataatagcctcccctttttgttctcgaaaattctcttgcccattcttcagtctatcaactcttggttcactgtcagctatcccctgggctgagcacctgggctgcagccataaacaggacctg

SEQ ID NO: 42 - DNA, 2516 bp, Homo Sapiens
ctcaacaaaatatttgcaaaccaaatccagcagcccaccaaaaagtgaatccaccacaatcaagtaggcttcaatcccaggatgcaagtttggtttaacatacgcaaatcaataaatgtgattcatcacataaaactaaagacaaaagccacattattatctcaatggatgcacaagaggctttcgataaaattcaacactccttattaaaaactcttaataaactaggtattaaagaaacacacttcaatacatatgtgacaaacccatagccaacgtcatactaaatgggcaaatgctggaaacattccccttgaaaaccagcacaagacaagggtgccctctctcaccactcctattcaacatagtattgtaagtcctggccagggcaatcaagaaagaacaaaatgaagggcatccaaataggaagagaggaagtcaaactattcttgtttgcagatgatgtgattctgtatctagaaaaccccatagttttggcccaaaagctccttcaggtgataaacaacttcagcaaagttttgggatacaagatcaatgtaaaaaatcactggcattcctatatgccaacaatggtcaagcctagagccaaatcaggaatgaaatcccattcatgattgccacaaaaagaataaaatgcctaggaatacagctaaccagggaggtgaaagatctctacaatgagaattgcaaaaacaccactcaaagaaatcagagatgtcagcagccagcccagcccgcctgcccgtccgcagccgcctgccagacacgcccagtatgagggagatcctgcacattcaggccggccagtgcggcaactagatcggggccaagttctgggaagtcatcagtgatgagcatggcatagaccccagcggcaactacgtggggaactcggacttggagctggagcagatcagcatctactacaacgaggcctcttctcataagtatgtgcctcgggccattcgtcgacctggagcccgggaccatggacagtgtcggctcggggccttttggacattttttcaggcctgacaatttaatctttggtcagagtggggccggcaataactgggccaggggtcactacacggagggtgcggagctggtggattccctcctggatgtgcggaagaagtgtgagaactgcgacggtctgtagggtttccagctgaccctctcgctgggcgggggcacaagctcgggtatgggcacgctgctcatcagcaagatgcatgaggagtatcccaactgcatcatgaacaccttcagcgtagtgccctcgcccaaggtgtcactgtggtggagccctacaaccccatgctgtccatccaccagctggtggagaatacagatgagacctactgcatcaacaaggaggcgctctaggacatctgcgtcagcaccctcaggctggccacgcccacctacggggacctcagccacctgacattggccaccatgagcaggatcactacctccttgtgcttcccgggccagctcaatgcggacctgcacaagctggtggtgaacatgggtgcccttcccctgcctgcacttcttcatgccaggcatgaagcccgggcagccagcattaccgggccctgaccgtgcccgagctcacccctcagatgtttgatgccaagaacatgatggctgcccgcgaccggcaccacggctgctacctggcagtggccaccgtgttccggggctgcctgtccatgaaggaggtggacgagcagatgctgtccatccagagcaagaacagcagctacttcgtggagtggatccccaacaacatgaaggtggacgtgtgtgacatcccaccccccagcctcaagatgtcttccaccctcatcagcaacagcacgggcatccaggagctgttcaagcatctcagagcagttcacggacatgttccagcacaaggccttcctacactggtacatgggcaagggcatggacgagatggagatcaccgaggccaagagcaacatgaatgacctggtgtccgagtaccagcagtaccaggactccatggcccaggaggagggtgagatgttcgcagatgaggaggaggaattggaggcccagggccccaagtgaagctgcttgcagctggagtgaggggcaggtggcgccggtgccaaggccagcagtgtctgacctccagagccatcttgctgtcgacactgtccccagctttcccccaccagcttgtcactcacgctagggctcccttgccaccctcctgcagtgtttacacccgtcctccccacctaggccacgtgtgtgctgctcctgtctctgtcttattgcagctccaggcctgacattttatggatttgttttttactggtttgtgtttatattttcagggatacttaataaatctattgctgtcagataaaaaaaaaaagaaatcagagatgacacaaagaaatgaaaatacatttcatgctcatggataggaagactcaatatcattaaaatgg

SEQ ID NO: 43 - DNA, 2364 bp, Homo Sapiens
gcaaagctggcactgccaaacagcagaggaagtatggcgtgtccaagaagtggctctgggaccattagagattctcatagaaaaaaaaatgatacggacttccacctcattcacaagccgtaagagccaagtccaggtgcgttataggctgaaatacaaacgtcaaaggtttacaaggtagtttccatggcagggcaagagttttttatttttttgttggttttttgttttgttttgagatggagtcttaatctgtcaccgaggatggagtgcagtggcactgtgtcagctcactgcaacctccgtctcctgggttcaagcaattctcctgcctcagcctcctgagtagctgggattacaggcgcccaccaccacgcccagctagtttttatatttttagtagagatgggggtttcaccatgttagccaggctggtctcaaactcctgacctcaggtgatccacccgcctcggcctcccaaagtgctgggattacaggcgtgagccaccacgcccggcttagatttctgaaacgctaataacattgacaatctggccacaaaatcttaaaaacttctgtgtatccacaaacaaaaaaaattgaaaagtcacagaatggaagatatttataccttctgtatattgtctttcaaaaatgtatcttctataaattaggaaaagatgactcaggagaaaaacaggcaaaaagcttctacagacacttcacaggaggaaactccgtgaccaaaaaaagatgtaaataggctccacttctgttgccatcaagaaactgccaatcggctgggcgcggtggctcacacctgtaatcccagcactttgggaggccgaggtgggtggatcacgaggtcaggagttcaagaccagccaggccaacatagtgaaatgctgtctctactaaaaatacaaaaattagccgggcatggtggcgtgcacctgtaatcccagcaactcaggaggctgaggcaggagaagcacttgaacccgggaggtggaggttgcagtgagccgagatcgtgccactgcactccagcctgggtgacagagtgagactgtcttaaaaaaaaaaatgccaatcgaaggcactgggcagcgtgtggtgtgtctcaaatgccaacgccacacagaggagccccagcttggcacgtctgctgctcacaaaaggagaggcgccctgtcctcttgatcactcaaagaagttctatgaatcaacaggaaaaaagcccacccaattaacacaacctcattaaaagtgggccagggaagtgaacggaaatctcccagaagcagcagcgtgttaggcccatccccatttgaaaacacaagtcaacctccctagtgcccgggaaaggaacagagaaagcagtgacaacccacatcacacccaccagtccaggaaaagtccaatcctggggccctgagaatcccacacgggcccagcacatcccagcccccggcccgtgctcccaggacacaggcctggggctggagacaggcttagcagcgcagtggcggtgccgggaggggcctgggacagggcaagctctgggcagatactcccccacctgctgagacccgagcacgtccaggcttgctccataagccatgcggggaggaccccgagtcatcctcaggccgtcgactccaccccagctgggcagacagctcctctcctcctgccactttctcaaatagccgccccacccccgtgagctccactgaggcccagacatacacccccatcagtgccgtacacacttcaacatctttgaaagcagaccatcttaacatcaacagcgtggcatagtttgatgggcagcatttcttggtggcacaaaatgatgatgtatcttaaaatgaaggacaccttagattccgtgaaataccaagttgtcagtggatgctgctatcctcatctgcctgtgcactggccggcctgtaagctccaggcgggcagggctggtaagcactggcgcaaggtgcacctgcttacgcggtgactccggtgtggggtgcagggtgtggaggtgggcgtagtgtccggagataccaacagccatgtgctgtggggaaggggcagggcagggtgggcagttttctgttctgttctctcctgtgcatttctgaactctttgcacagctgatactttcaaggaaagcatatatatatagcaagggctgtgtatgcaatcaattcacttccagtgcagggcaaggaaattaactccaaaggagagactgcagcccagagcttcctgcagggcacccacctggatatgttccgggaagaggggcaccggcccccaccacagccccagccaggcttgtgggaaaccctcctcacccc

SEQ ID NO: 44 - DNA, 2408 bp, Homo Sapiens
acacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtg

SEQ ID NO: 45 - DNA, 2523 bp, Homo Sapiens
ctcgtgttaaaggtcctgtgtggttgtttttctaatctgctgggtccttttcatgctattatattgtttttcatttctacttttatctctttagtcattttaaactcatgtataatcttttttttttttttttgacagattctcactctgtggcccaggctggagtgcagtggcgtgatcttggctcactgcaacctccacctcccaggttcaagccattctcctgcttcagcttcccaagtagctgggattacaggcgcccaccaccatgtcccgctaattttttgtatttttagtagacatggggtttcaccttgttggccaggctggtctcaaactcctgacctcaagtgatctgccctcctcagcctcccaaagtgctaggattacaggcgtgcgccaccacgcctggcctataatctcttaattgttctattattatttctggttcttaagatactattgactgggtgcagtggctcacacccgtaatcttagaactctgggagaccgaggcaggtggactgcttgagcccaggagctggagacagcctaggcaagctggtgagactctttctacaaaaaaacagaaaacgtttattggacttggtggcactgcctatagtcccagctacttgggaggctgaggcaggaggataacttgagcctaggggtccaaggctgcagtgagctatggttgtgccactgtattccagcctgggtgacagagcaagacttcatctctttaaaaaaaaaatggaacattaaaaattagaagatggtgccgtgtctgccagtccctcggggtgtgagctcaccattgcgggccatttcttctatggagcccaagccccagggggacatatccccacggagggtgcatgtttgcctttgctggagcctgggtggcctctaggtcctggaaccagactccatatcccccaccccgcccactggctgccagtggtgccccatccgtgtcctggtgacagaggcagcgccccgggggtacaggcaccggcgtcagctttgagtctgaaccccagcccggccccagtcagctgcatggctgagggtgggtgggggatgcccctgccttgatcccccacatcctcacctatagtgcagcctcacctccctcacaggagtcggagggccacatgggaaaacaggcatggtagacgtaaaaggcccagtggaaatgccggttctccttgctgccattactgcatttatctggcaaccccgcaccacaacccgagacctagaagaccctatgccccaggcggggctgaacaggacagacctcgaagagccggtccccagatcggaccgccaacaaccaggccggattccgcgcctccagccggtcagtgccttggcaaggcaggagcgggtgaaactcccagccctcccagggagcagtcagatgatgacacatccacacccgtccacagggagggagtgcgacaaggcctgtggctttctgcgcgagaatcggccagtgtcctttggggcccgggatggggtttcagcacccactctcactaccggggctcgggagggagggctggagagcctccatctggtgccgtcggtggccactcctcagacagcgcgggcgggttcgcaggccctgggcaaatgtggtgttgccacagccccgccctacagggacagcggtcagcagctgcccctggccccgccgtccctaatgaagttatagatggcagctcttaaatgtctccagaaatggcagagaggctcccagagctgacgtgcaaataaattgcttctcaggctcggaccacacaattctgctgggaccaagcacaggcctgggccctccggctgcccctcagggcctggctctgctgagaggaggaagcctggctcttgggagggggtctcaggtgccccctccatggagcccagcaacctggcaggtgggggtgggcaccgcccctcccccgggactccatctccccggcaatcagctgcctctcccttctctggggccccaggtggtcctcatggaggggtgggtgggactgaggcctgagccccggggaggagctggctggtgagccatgtatcccagtggtcactgcggccagccggggaggttgaatcccaggccccagcactcagaagctggtggagtgggttgaattgagcccctccaaaaacgtatgtcgaagccctgaccccgggtacctgcgagcactggaaatggggtctttgtgaatgatcgagttaagatgaggtcggacggggagggtcccaaaagcaacgaccggcaccttgtaaggaggctgctgacagcagggagaagtcgggcgcgtgacgtcagaggcagagactggagagaggcagcccaggaacaccacgggtggctggcagtgcggagcggtagggccctcccctggaggcttcggagggagtgtggccctgcggacacctcgatctcaggcttgcggccccagggctggaggggtcgcgtttccgtggctttagctccca

SEQ ID NO: 46 - DNA, 2280 bp, Homo Sapiens
cactgttttgtctgtcttgagaatagcattcaacgcgactgtgttcccgcagcagacgttaggccgctgcccacgccttgagtgccggacgaggtcaacataggctttccgtcacagaatatgtttgggcaggaagatcggaacacttggggctgggcatctaccgctcccccacggcacacacgagtcgtcagggaaatgcccgcctctgtgtgtgttgtacgtgcagccttctgggcagagccgtggagagttggacgtaggccaggtgtgaggaggagaggtgtgtttggggtggccactggctcccttcctgcgtgacgtaggctggcgtgggctcttcccccagccccttgccggtgctgccacgtgagaagggcccgggtgccggtcccgctattccggaattgtgggttcacctgaagtttgaggccaaacccccagcggtcagtgggacgccagtcgcctttgacctcttggtcaagctggccttgccgtgacccgtgagaatgcccaagtgccaatgtgtcccggggggcagggccggggctgggatcctagtgtgtgcccagtctccttctcgtccctgcgggttccaccatcctcccatcctaacgcatcgttagggatgcggttaggtcgggtccatccccagggcggtccaaggggaccgctttctggtttgtcaggaaggcaggctagtaagaagggtcccgccgagtcccatctgccaaggacagggtcccgcaggtgggccagggctggcccaaagcggccgagatgctgatccgccatgtgcggggcgctgttggcgttttttcctcagcaaagggcggagggagtggacgtgggggaagggcaggtgggcatttctggagcaatactgccatcaagaggaactggcttggcaatcccgcgcacccttcgctgtgctcgcctggggaggagtggcttgggactgtcctgggggaccaggcaggactagggcaggtgctcggacggatccgaggtctctggaggtccgagagaagcaggctccgccgcggggtcgggcggtggaagccccagagagaggcgccaggactagctggacagccaggacgccgggccgttcccggacaggaagccacggctcgggagcctggtggcggccatgatctgggcgggaccagcggaggcctccgccagggagcctgggctcggggccttgggcagtttgcctggtgccccttcccgtgggagcaaccggggtgacggcctagctgggtcctcggcccgggaggctccgtcggccacactgcacgcctgcggtgtgaggagggccgactgccagtgctgagttccgtggccattggcgcgggtgcccgccgctgctggccggcgccggggcgttcctccttgcgtcctagggaggaaggtgggccgcggggcatcccgcggggcccgtacccagacggttcttgacgaggtggacgcaaggccaggcccggcccggcccggcccggcccggccaccttcagacgccgcgcacccgccttgttgagacttgccaccctgtcttgttgtgtccatgtccccgaggttgtcttggaggcgggccgttccccgtggtgctcatttctgcctgggggccttccggggaccccgcttgtctttgggggtgcgcaggcccttgccctgcgatcagaggcgcaccgaccgatgagttcggtggcaaagcttgagaaatggagactctctgggcatcggctaagggggcccggggccttcccaggcctgctggagtccgggaagccgggggcacccagaaggaaggacccgtcggactctgcctggggacagcctgctccgcgccagaagggtccgctgctcaggcagcatccccgtgcctctcctccagtgggtccctcaggtagaatcggggcaggccccactggacgtgcagggaggaggctcggaggatgcatcctttgcaggacccggtctggtacagcagcagacggagccatctcccggggctttctggcttctccgagggtgttcaggagtctcccaagtgcgcaggggctcgtgcccaaagggtggaggtcggcaccgcttcgctcaattcaggagtggagaaggaagctagaggaccctctggaggtggcaggtttaatgtcctgcttttttatttatttatttatttatttatttatttatttattttgtaatcaactgaaagaaggcagaaggagtcgatgggcctcttaggccggaaaccttacaagcattaggacc

SEQ ID NO: 47 - DNA, 2413 bp, Homo Sapiens
ctgcccgccccatccagggacagacctgcagggcagggactctcttgcctacagaggcacacgtggcttcggcgtgttccaaaacccagctccccatggccgctctaatctgagctctgtccccaaggccccaaagtcagtctgctccttcagaggtggggggaagcagctgtgcctcccacctcaggacacacacgcacccactccccacaacacacaggcagacacacacccagtccccacaaaaccatgggcagacacatgcccagtcctcacagtgcaacggccccaaacgtacccgatcccaacgccacacacacacacctggtccccacaataccagggccacacacactccccgtccctatgatgccacagcctcgggcgccccttcaccttggccactgcccttggtgtggtgccctcactggtgagataggatgctggccccagagctcatcggccctcgcccacactgtgtgggcaccaatgctgccaggcacagctggtggtgagccctgggcgtctcctaggcaggctgtgccgactctcgtcccacctgcactgaactgtccttgaggctcacccactgctgatcccacgcagggtcacacctggcccactggccagtgttaaagcccacctggcccactgggcctggctccatcctgtctaacccatctctggccggattctcttgccacgtcctccagcatcgcaccacccccagcctgcccagtccccactcctgtcggcagcataagcgctgcccagaagagctgggggtgcctgcggacctccctgctggcctccgtgatgccgcctcaatccacaccccctctcccggcaagggaaagagaagagaacaaagtgcagcaggcttagatccagaagctcaggtccatgagtcaacagaagatgctaagatgctgatgcagcacgacccaggagacagcagggaacacagccccagcggaacgagaccaggccctgctccccatcccgggcccgccgaggggacgtgcgcactcacttggtcatcaccatctccatgagcatcttcagggtcgggtactcctcccacgcagccaggcctagggaaccggagggtgtggggctggccaggctcccctgggcaccaggcgtgtgacccccgcttctcccagctcctcctctcatccccagctgggctcatcccaagtcccaacagacaaactgccccaaaggaataaggaccagcagggccacgtgtgcgcatggggcggccagcagaggctcaccgatgttctctgggttgaatgcggcgacgaccagcaggaggggccaggccttccagtagagggtagagatggcgaggttcggaggctggtacctggaaggcaggggcgccccgactcaggcccagcgcaccaagctcagcgccaaggatcggccgggccaggtggcaaagctggggcagggacggtgctggctcccagctcctcccgggactgccctccagtgacacctgtccaagcatgtgcatcagcctggctctgggctccctgtccaggcccgactccggctctgtccttacctttctaagtctctgtttcccatctacaaaacgggagcggtggtggatacataataaacgttcattaagtgacaatgatttttgtactctacatgacataacagacaccaccccaggagccaccgagatggaattattgtaacgatacaattaaatcaaagcacgggcccctcgggtgaggaaacggatcctggctatgagacagatgtgaatcgaggcactgcctggagccacatgcagaggctgctgagtgggaaagaccacaccagaaagcagagcgggcagcacctgccgaaggagagaggcaggagaacctcaaccacagcatcagagagcacgcgaggctcaagtgcagtgcgggattccgaagtgcgtccgaccaaaactccaaacgctactgaaagggtgtcagctctgcataaagggacgcccctgaaagggtgtcagctctgcataaagggacgcccctgaaagggtgtcacctctgcataaagggacacccctgaaagggtgtcggctccggataaacgggaacccctgaaagggtgttggctccggataaacggacaccactgaaagggtgtcagctccggataaacgggaacccctgaaagggtgtcgcctctggataaacgggaacccttgaaagggtgtcggctctggataaagggaaacccctgaaagggtgtcagctctggataaagggaaatcctcccacgtgcacggatcgcagggcgtggcctcactgacatggtggcactccccagactgacccatggattccacactgtctccctcgaaatcccagtcatctgttttgcagaaactgacaagctc

SEQ ID NO: 48 - DNA, 2171 bp, Homo Sapiens
caagagaaaaacaaaaaaccctattaaacgtcacggacaaggccagagtttgaatatactgtggtcatctctgctccagtgcaaactgttttcagaaagcctacttctattttccttgctgtaacagaggaacatttcctgtcttatgcttattctactctgcaatcccctaaggctttttctctccctcccagaatcttaaagtgcattcgaactcacaggcaaaatcctcccagaatcttgtgagaacataaatgatctgactagtttggcattgcttttggggatctgggaaaatctgtgcacacttctggagacccttgtcatgccattatttataaatctattgtgcctcaagtcagaagtgtgtgaggggagatggggagacattgggatgcgcgcgcctggggctctcccacagggggctttcgtgagccaggcagcgagggccgcccccgcgctgcagcccagccaggccgcgccggcagaggggatctcccaacctgccccggcgcgcggggatttcgcctacgccgccccggctcctccggagccggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgccccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggcgcctcgctggaagcacccctcagcgaggaagaataccgggctctgctggaggagctttaggacgcggggttgggacggggtcgggtggttcggggcagggcggtggcctctctttcgcggggaacacctggctggctacggaggggcgtgtctccgccccgccccctccaccgggctgaccggcctgggattcctgccttctaggtccaggccggtgagagactccacaccgcggagaactgccattctttcctgggcatcccggggatcccagagccggcccaggtaccagcaggtgggccgcctactgcgcacgcgcgggtttgcgggcagccgcctgggctgtgggagcagcccgggcagagctctcctgcctctccaccagcccaccccgccgcctgaccgccccatccccaccccccaccccccacccccggaaaacgcgtcgtcccctgggctgggtggagacccccgtcccgcgaaacaccgggccccgcgcagcgtccgggcctgacaccgctccggcggctcgcctcctccctgtcgcccccgggccaccgtcgcccgccgcccgggcccctgcagccgcccagctgccagcacggagcgcctggcggcggaacgcagaccccaggcccggcgcacaccgggacgctgagcgttccaggcgggagggaaggcgggcagagatggagagaggaacgggagacctagaggggcggaaggatgggcggagggacgttaggagggaggcagggaggcagggaggcagggaggaacggagggagagacagagcgacgcagggactgggggcgggcgggagggagccggggacggacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccggggcccagggagtgggcggtttcctccgggacaaaagaccgggactcgggttgccgtcgggttttcacccgcgcggttcacagaccgcacatccccaggctgagccctgcaacgcggcgcgaggccgacagacccggccacggaggag

SEQ ID NO: 49 - DNA, 2490 bp, Homo Sapiens
gaccagcacggccaccacacccacagtcatcagctccagagccactccctcctccagtccagggactgcaaccgcccttccagcactgagaagcacagccaccacacccacagctaccagcgttacagccatcccctcttcctccctgggcaccgcctggacccgcctatcacagaccaccacacccacggccaccatgtccacagccacaccctcctctactccagagactgtccacacctccacagtgcttaccaccacgaccaccacaaccagggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacagccaccggctccaccaccaacccctcctcaactccagggacaactcccatccccccagtgctgaccaccaccgccaccacacctgcagccaccagcagcacagtgactccctcctctgccctagggaccacccacacacccccagtgccgaacaccacggccaccacacacgggcggtccctgccccccagcagtccccacacggtgcgcacagcctggacttcggccacctcgggcatcttgggcaccacccacatcacagagccttccacggtgacttcccacaccccagcagcaaccaccagtaccacccagcactcgactccagccctgtccagccctcaccctagcagcaggaccaccgagtcacccccttctccagggacgaccaccccgggccacaccaggggcacctccaggaccacagccacagccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggcagtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcaactccggggacgacctggatcctcacaaagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccaccacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccgtcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcac

SEQ ID NO: 50 - DNA, 2418 bp, Homo Sapiens
agcagagctggggtgtggagccgggctttcccgtcaccactgctacccctaacggtgccagtgctggtgggtgtgcaagggccgcgaaagccatcgtgtgtggcatggcaggccccatcggagggtctccctggccgaggggcctgctgtggcgttggaggggtaggggcctactgcttctcatgaggctcctccctccctgacagtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggtgagtggccgggggtgggctgtggctgtcctggagttgggggtgggcccgggcctgcctcctgagccgcccccatcctcccataggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcagggtgagtgctgggtgcgggacctcggtttccccatctgtgagccgcacagtttccagggtgggtgtgaggtgctgggcatctggcccaggactggtcacgggtgggtggctgggtggcctggtggggacttaggcctggactcgtcccacagaggctgacggagcagccccccagctcacggcctcgcgcctcctgcagcgacggcagatcttcagccagaagctggtggagcatgtcaaggagcaccacaaggtgagcggcccccggccccgctgtgtgaagatggtggcaccagcactgcctcagcacctaaccctgtgcttggagcatccctgccactcacagcttctcccgggatggaactgggctgggttcaccctgagctgagggctggtgtgctcagggtgcagccgcaggcactgaggaggtccccaaggcgttcagcgagcgcggaccatgggaggccttgtgctctccctccaagctgagcactgggcagaggctgagtgacttgcccgaggcggcccggctgggacgtaagcacaggcctacctcacatgcagtctgcccttgtctcagatgtgcccagggtcacccatctactccttctccccaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccagggtgagactgcgaggcttgggcagcccatttctcccgggtgggtgggccagcctgaccccaggcttaagaggtggaagccttggtgatgagcttgacgcctcatctggcttcctccttggctggcggatccagagagttggtggcatttgccctctgtccccagctgcagcctctaagcctggctctgccactagccccatgtggggagttggcctgggcaggcgatgctgcacactgggacactgcattgaccggcacagaccacccagtgtgctgggtgaacttgtgccttgagagataccggggactcctgggcagacagccaggggcacgttgcatcttgtgacctctccagtccaacctgtccctcccgcagatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcgggtgagtcgtccccagtgatggcgggtgggcgcctggtgacctgctgcccactaaccaggtcccggtacctgctgcagatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggtacgtgcagggcggggtgaaggggcgtgcagggtggaattgcctggtgctgcagctgcctccccagctttctgagcagaggtgtctgtcactgatctgttctgttcagatgtgcagtgggcgctggcctcttgcactggtgtgtcctgggcgctctgccctccttgga

SEQ ID NO: 51 - DNA, 2351 bp, Homo Sapiens
aggccggcctcgcagctcccggggccgagcccccaaacgtgagccgggtgcgcgcgggactcgcggcggttttccgaagctccgctccctcggctcggggcccgcccggctcgtcccaacagctgccccgcggccgtaggccccgcgctctgtgcaccagggaaaagcagctcccgagtttgtgccggacgctcctgcgccccgccatcggccgttcccggcccctgggtgaggcgcccccttcccgccgcgctccgctgccgggtgccctcggcctcggcctcccgtgacctctgacccctcttggtgcgaacaagaccgggcgtttcgccgccgacgcgaaggggctgtctgtgcgcggcgttgcgggccctccgcgcgtggggtgtgcgtgtgcgtgttcgggttcggttctgtgtgtgcaccgcgggcctgctcagagtcgggaccaccgggctgcgtgtgggccgccaggtcaggccctcgcccaggatgggccctaagctggaacgagaaaggggaaaccggccgcgctgacgccggggccttcgctgcaagcgagaggcggactcggcgcacccgcgcggccctggaaacttccgagaggccccagctctccgccggctccacctctgccaggtggggaaggtggcccgggaccgggtccgctcaggaccagaagtggtgcctggcagccatctggccaggaggccggagagccgggcccagcgggagcgccgagcgctggcttccttttcccgagagtctttagtgaggaaaaaccccatgagaggtgactgccaggcctcggccctctgtccacacttggccgagcgctgggaacccctccttccaggctccacagctgggaccgcttgtcccaggccccccaaggtggctgaggcaggttcaggatcacactgcctgccctgagcaagaaggcaggatccgctgaagaatttcatttcatcaggcgatattttaagcagatgtgaacttccccggggaccatagtccattacccgagtcagaggcggtagggccagcactccagccagcaggtcctcccctccccacaatgctgaccaggtcaggggactgtggggttgggcaggggcaaggtcatggttaccaggttggtattcaggctgggcacagaacagcaaccaggccagtggaggtgaccccatgacccagcatttcgggggccaccgccgagtgtgcatctggaggtgtaatttcgtttgtgtttccctggagaccccactccaagcctcagttcaggtgggttagtcctctggattgggtcttgtgaagggccaaatggtggcggctccgggggtgacccgggcttccagctgagctttccaaggacagaggtggccactggggcacccaagccggggctgtggctcagctgatgggaaacctacagcctcctccacctgagcctgggggccaggaacagagtgaggacagttcagggacagggtcccccctactgaagccagggcggtagggccggtggggtaggggctgctgcagccccacatttacaaactcaatgcttaacaaaagcttattgtttccagggctgttgtgagccaggtgggcaggtggggggttagcaccaccaaggtgctctctggatcaccatcgccctcatagcacagctgggggcctctgtgcaggaggaggatgtgccagtcggcacccccatcagagctgctccttgaggcctgatccccacctaggtggcagaccccatgtcctagatgccacataccccagggctgggggagtgtcctctccacaagtcccatctagcccctggggtgggggagctgcagcccccactagatggggactgtgtgtgtcttgctcgtgtttgagggtgatgcgtgtggaaggtgtgctggagacagggtagaggtaagcggggctggcggcccagttcacagcctccttccttcttcgtagaaacaggccaggctggctgggccctcccttctcccaccctccctggggcagttggccccgtccaccagtcccctccccagagccaggacggcagccttccctctgaaggccggttagggcagcagcgccaggacgtccggcgggaatccagcgtcttgccccgcttcggacgaaaacacagaggctgcggtggaggggtggagtgcggggctggccgccagggcttggtgccccacggcagtggactgtgtgtcacccacaggccccctccctcagcccctggctgcgcaggtgtgccatggctcggaagctggcaggaggggcttgccaagctggcttgtggagcaactgctgggtgggctccttgggga

SEQ ID NO: 52 - DNA, 2427 bp, Homo Sapiens
ggcattcctggcacctccaagccatctgctcttcagcctctgggcccaggactagactagtgctaaaatagctgctcctgggaggggctggacccccaccgtgggcagagagggcctctgctttttggggcaggaggggccaccctggcagggtaaaaagagataaacagaaaaacaacagcaacaataatagtaacaatccggggttgttgccatggggcctgttctgaacaggctgcgcccagctcactgcgaggaaggacgcttagccaggccctggctgaagcctgcagctgggctggacacagcagtcattggcctgtgttgtgggggacttgggcctgccatggctgcagtggggaccctgcctgagacagacagagctggggtggtgaccaacaccgtcggggcaccctcgcaggaactgggcctggtgaactgcccagggacggggaaggagcagggtgaggcatggggaccccgacacaggttgagcagcgggagaggaggctgaggaggggaaggagggggcccgcagagtagcccccagaccccaagtccggtcagggacaagcttgttagctccaggttcatgtcacaacctgcagggctcctaagttcaagcttttttaaacttaatgggcaaactgagacgcaacacaaataggcttctgaccttggtgtctgagtcctggatctgaagtccttcacggcactcactgtgagcccctcttagacgcactgcacgaagtgagcttgccagctcttcctttaagaaacgtgttaggccgggcgcggtggctcacgcctgtaatcccagcactttgggagaccgaggcgggcggatcccaaggtcaggagattgagaccatcctggcgaacatggtgaaaccccgtctctaccaaaaatacaaaaaaaaaaaaaaaaattagccgggcctggtggcaggcacctgtagtcccagctactcgggaggctgacgcaggagaatggcgtgaacccgggaggcggagcttgcagtgagccgagatcgcgccactgcagtccacgctgggcgacagagcgagacgccatctcaaaaaaaaaaaaaaaaaaggtgttaaaatcccaaaaaaccctaagataaagcaagtgtgaaagtaagatttttaaaccatttatggttccggttggaagcagtttctgttctgcctggcaggaatttgggagggtgactggtcccctgcagaggtgctgcaggctgggcctgccctgtgggcagatactgagcccaggggctcctccagccggggccacccctgcactcccaggcgcgttggcccagcacgccctgcttagtggaggagctgagatgaccagatagagagcctcgccctggcctgggagcagcctgcggccaagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccggtgtccctggtgtgggcctttccttcctcccttgtggagaggagccccgactcctcagggatctcagacccatcctgacgcagtcactgctggcggagtagggagagaccccggggcttgcagatgctgaggggccttctctgcagaggggccctggccaccacaggccagtctggaggtccccagctttgggggctggccacagtccagacgcccctccctcgcctcccccatacccacttctaccctctctgtctggctctaggtgacccagggcctggtcatcgggcagctgagcagccacttctcggaggaggtgctgctccgggccagcgtgctggtcttcatcgtggtgggcctggccatggtgagggctccccgctttgggcccactcacctgaccctctcactgggcaaggccacctgggcggtaccatctgtgcttaagcccttggggactcctccagccccccacacccacccggggccagctcttcagcagggacagcagtcagggtggggagggacaggtaagaccccagagaggagcctggtcccgtgaggcccccactcagctcggcccccgcctgccgtcccaggcctggatgtccagcgtcttccacttctgcctcctggtgcccggcctggtgttcagcctctgcaccctcaacgtggtcaccgacagcatgctgatcaaggctgtctccacctcggacacaggtgagtgtggccagcgagtggag

SEQ ID NO: 53 - DNA, 2501 bp, Homo Sapiens
tctatacacattatgtcttttaaatgacacactagccttctgagggtaacttatattggcaacagttttcagatgtggaaactgtgaagacaatgttggtgatgtggaagcaacataaactttggagtctttcagacccaggtttgaatgtcagactgctttttattcagagtaacttcagagcattatttctcaccttaattttttttcaggcctctttgtgtctatgtgtcctcttcactcctgtccattgttcattcagtgatttttgcaccttccttcactgttagtgtgtagacacatagttctcctggctctgagacctatgttaattccattctaccatcctgccagcccactcaattcctattgagcaatgctagttgaaagttgtggtgggattaaatgttgcaatgagtattcaaatgaggttgaagtatctacgcattctacttacatatggtgaggtatattcaaggaaggctgtagccattaaaatctcaggaaataatttttcacctcctcaggtgaaagggtcttcaggcctttgtgttctggaaggttcatttatagccatttcccaaatgacaatgcgattgatgagtctagagtctagctcaaatagcaatggactggaagactagtttaggttttactaatgtggaacatagaacaaattatgtccttgtttcagcctgttcatctgtgaaatagagcctatcatatccagtcttccttgcctttaggtttgagttaccttctttggtcaaggtaagtaaatgcctatgatgtttggctgtgcacaagataaagctacaacaaagctacaacccatcttttctctgtagaagactgcaaaaagcaaaagagacccaggcaaaaatctcggaatgacttttggaacagagagcctccccagaatcagaagtcaaaggaatttaaaacatagggaggcccagggtctctactgacataaaggaaagatgttttccttataggtttacgtttacattttctctctctttccattcccacttgcatctccacctttacacagggcttatgggacctcctccacaaaagagcagttgcagtaacccacatcatcctctacgcctggctgtccatcaagaggcgaaaagcagccctatataggttctatccttggatagttccagttgtaaagtttaaaatatgcgaaggcaacttggaaaagcaagcggctgcatacaaagcaaacgtttacagagctctggacaaaattgagcgcctatgtgtacatggcaagtgtttttagtgtttgtgtgtttacctgcttgtctgggtgattttgcctttgagagtctggatgagaaatgcatggttaaaggcaattccagacaggaagaaaggcagagaagagggtagaaatgacctctgattcttggggctgagggttcctagagcaaatggcacaatgccacgaggcccgatctatccctatgacggaatctaaggtttcagcaagtatctgctggcttggtcatggcttgctcctcagtttgtaggagactctcccactctcccatctgcgcgctcttatcagtcctgaaaagaacccctggcagccaggagcaggtattcctatcgtccttttcctccctccctcgcctccaccctgttggttttttagattgggctttggaaccaaatttggtgagtgctggcctccaggaaatctggagccctggcgcctaaaccttggtttaggaaagcaggagctattcaggaagcaggggtcctccagggctagagctagcctctcctgccctcgcccacgctgcgccagcacttgtttctccaaagccactaggcaggcgttagcgcgcggtgaggggaggggagaaaaggaaaggggaggggagggaaaaggaggtgggaaggcaaggaggccggcccggtgggggcgggacccgactcgcaaactgttgcatttgctctccacctcccagcgccccctccgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagct

SEQ ID NO: 54 - DNA, 3190 bp, Homo Sapiens
aggagttcaagaccagcctggccaacatgatgaaaccctgtctctactaaaaatacaaaaattagccagtcgtggtggcgcatgcctgtaatcccagctactcaggaggctgatagaggagaaccgcttgaacccaagaggcgaaggttgcagtgagccaagaacacaccattgcactccagcctgggcgacagagcaggactccgtctcaaaaaaaaaagagctggtcagtgtcaaatgcttagcacagagactggcacagtaatcttcaatgtccagcacctattgttactattttttttttttttttttttttgagacagagtcttgctctgtcgcccaggctggagtacagtggcgcgatctcggctcactgcaagctccacctcccaggttcatgccattctcctgcctcagcctcccgagtagctgggactacaggcgcccaccaccacgcctggctaattttttgtatttttagtagagacggggtttcactgcgttagccaggatggtctcaatctcctgacctcgtgatctgcccgcctcggcctcccaaagtgctgggattacaggcgtgagccaccatgcctggccctattgttactatttttacccctcacttctgtacagagcatttatggctcaagaaacatttgtcattttaattgtatgggagtcccacaacagcatagggagacatttctgatcattattcccattaggagggtggagaaactgaggctttgggaggtggtcctgacctagggaatcaatttgctgactcactaacccatgaagctctacagttaaaaaagactagattaaaaaatgagaactcagtaaaggggctgaggcaggaggatcgcctgagttcagaaatttgagatcagcctcggcaacatagtgagatcccctctctagaaaaattttttaaaaaattaggccgctcgaggcagagtgcagtggctcacgcctgtaatccaacacttcaggaggctgaagagggtggatcacctgaggtcaggagttccagaccagcctggccaacatggtgaaaccccgtctgtactaaaaatacaaaattagccggtgtggtggcacacgcctgtagtcccagctactcaataggctgagacaggagagtctcttgaacccggcaggcggaggttgcagtgagccgagatcgtgccactgcactccagcctgggcaagacagagcgagactccgtctcaaaaaatacaaacaaaacaaacaaacaaaaaattaggctgctagctcagtggctcatggctcacacctgaaatcctagcactttgggaggccaaggcaggaggatcgcttcagcccaggagttcgagaccaggctgggcaatacagggagacacagcgcccccactgcccctgtccgccccgacttgtctctctacaaaaaggcaaaagaaaaaaaaattagcctggcgtggtggtgtgcacctgtactcccagctactagagaggctggggccagaggaccgcttgagcccaggagttcgaggctgcagtgagctgtgatcgcaccactgcactccagcttgggtgaaagagtgagaccccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccataacccacctagaccctagcaactccaggctagagggtcaccgcgtctatgcgaggccgggtgggcgggccgtcagctccgccctggggaggggtccgcgctgctgattggctgtggccggcaggtgaaccctcagccaatcagcggtacggggggcggtgcctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtaccccggatcccctgacttgcgagggacgcattcgggccgcaagctccgcgccccagccctgcgccccttcctctcccgtcgtcaccgcttcccttcttccaagaaagttcgggtcctgaggagcggagcggcctggaagcctcgcgcgctccggaccccccagtgatgggagtggggggtgggtggtgaggggcgagcgcggctttcctgccccctccagcgcagaccgaggcgggggcgtctggccgcggagtccgcggggtgggctcgcgcgggcggtgggggcgtgaagcggggtgtagggggtggggtgtggagaaggggtgccctggtgcaagtcgagggggagccaggagtcgtggggacgatcttcgagggaaggagaggggcatccgtagaaataaaggcacctgccatgccaagaaaggtcgtaaataggagtgagggtcccggggataagaaagtgaggtcggaggaggtgggagcgcccctcgctctgaggagtggtgcattcccggtctaaggaaagtggggtactggagaataaagacatctccaataaaatgagaaaggagactgaaagggaacggtgggctaggtcttgagggggtgactcggcggccccctcccgggagttcctgggggctcggcggccgtaggtttcggggtgggggagggtgacgtcgctgcccgcccgtcccggggctgcgggctggggtcctcccccaatcccgacgccgggagcgagggaggggcggcgctgttggtttcggtgagcaggagggaaccctccgagtcacccggttccatctacctttcccccaccccaggtctcctcttggctctgccaggagccggagccctgccaccctggctttgacgccgagagctacacgttcacggtgccccggcgccacctggagagaggccgcgtcctgggcagaggtgagggcgcgctgccggtgtccctgggcggagtagggaggggttggaaaggggccgagaaattgcactcccacacccctgggttgcaatgggcaagctccctccttggctcaaacgacaccccttggaa

SEQ ID NO: 55 - DNA, 2613 bp, Homo Sapiens
gaatggggaagcctccaccggcggttatctcctcctcctcctagcctgggctagagacgaattatctgtttacgaaatcacaccaaacaaaacaagtgccgaatgcgccccggacttttcgagggcctttcctacctggtcttctaggaagcggctgctgccctagacgctggctcctcagtagcatcagcacgagggccacagcggcgggcgcccctggcgctgcccactcccccgtgagccgcgggatgtgaaccacgaaaaccctcactcgcggcgggccgcacgcgcgccgaatccggagggtcaccaagaacctgcgcaccatgttctcgccgcctccagggccgagctcggcagccgctgcgccgccctttggcaccagaggtgagcagcgccactcctgcccccttaactgcagactgggacccacgcaccgccccctgcccatctccgccccgcaggcgcgcacccgccttccctgagcgcgcccgccccccaccttcacccccacccccaccccacccccactcccacccggacctccaagatctcggaacggctctgagccctgcgcacgcgggaagggctgccggaggcgcccgtagggaggcgcgcgcgcgggcggctcagggcccgcgttcctctccctcccgcctaccgccactttcccgccctgtgtgcgcccccacccccaccaccatcttcccaccctcagcgcgggcgccccgcggtgacggcccaggggccggacgcctggaacgcaactccaggcagctcgccccctagctacatccgtcacctgacacggccctaccaggaacagccgcgctcccgcggattctggtgctgctcgcgtccccgctcccctattccccttattttattcctggctcccctcgtcgaaagtcttccattcttcaaactagattatttaaaaatgaaaaaggaagaaaggaaagcgaggtcatctcattgctctatccgccaatcaggaggctgaatgtcagttttgaactaaaagccgctccgctcctcttctagatttggaaaacaagcgaaattaaactaaaccgctgcacgcctctgacgcgacatctggacacggcgcggcgctggcgctgccggagctgtcgacccggcctggcgccggactaggtaggtggagtcgcacccgggggtcccagctgggtccgggcgcccattcccctcccagctgcccgcgtcgccgagggcgcctggctgggacaagcaccgagtcctttgtgtctagcccatttttattttcggttttaaccttcacgacagccgcggagcatctgagcgcttcttcctctttcctcttcccccgcgctcccctcccctgctggccgctcccctcctgtcgccgcgtcctcgcgtagaatggttgtcttggcgaccgttggccgctgccgcctccacgctctgccccgcgcccagacaccccgactccccttgatcccgccgcctgactcctcggcgtacgttctctctccggtctccccctccatgtcccctcctccccttttcttccacatcaccgatcctttctggactctctcccttcctcctttccagctgggagacaggaaaagcggtcctgtttgggaacagtaaaagcagggcaaggaaaggaaggagcggcagaaaggaggggtgagtcgaggacacaggggcagccggagaatgcggaggagccgggtcctgagcgcggtctaagcgaggctcggctctcgtccaggaactcggacgcgggctcgccggctctccgcgcgcgggaagtcgagcccaggacgccgccttcaggccggcgcgctgacccggtgccccgacccggagcctgcggtctgcctggatccgtcctaaacctcgcgggctggacccgcggcctgagtgggtgggtgtgtgccagaggattcgggactaggcccagctccgggaacctggaaatgtggcccgcttctcagtggcttcctgttcatgcgcttgggcctagtggcctagttgaagaagtggaaccacagcgtgagccgacagggccttacagatcagacgtcaagccccccagaccttacaggggaggaaagtgaggcctgcactggccgagccacccacttaaggcggtgcggtagcctagaggagcggcagacttctctttccccatcccccgccccatcacttgacgttgctgccggacctcggtacaaacccaagacaaaacggggccctttggaaaaagtgagatttagcgatcactcttacgtagccactctaaatatctatctagatatttacaaatgcacctccccggtaggtagatttcactcagaatttacccaacaccgtgctttgtgctggggccacatgccacctttctgtctagtatggctgctctttctccctcttcgcaaatatagctctttttccttcaggtctcttctgaagtaagtagcccttcctcagaaatgcttcccttttcaggcaccctcataccaccgtgatttttttctttatagcacttaggacgaagagattattttacttatgtacttgtttacttgtttgttgtgtagaatgtcagctctatgggaa

SEQ ID NO: 56 - DNA, 2501 bp, Homo Sapiens
cgtcactacactgtactgcctgtggatgacttacttgtccctgtagtttcatctgaagaattcctcctccttttcctttgaggcctgcctcaaatatcacttcccctgtgaagactgcctggtgttctccaggagagagtgtgactcccttctctaggaatggtagcaccccaaacacacacattttgcagcatatttcaccttgcatggtaatggcctgcttgtgagttttattccgtaccagagggtgagggctctgaagatagcgccaggtcttatttacctcgataccccacaacactcattacatgtctgatgaatgaatgcatagggggatggctgggtgcatttctctcaacttttcaatttcttgaaataaataacaaaatcttaccttccctcagaagtcctggcatggttcctttcatcttgccacagccactgataatcactttcattttctgtgtaactcaccaggcaagaagtccatgcagatttacttttagtagttcacatgacaaataaatactgcgtttgatttccaaacattaaaccatagtatattatagatagatatagagttatcattcaaagtatgatatttcaatctcaaaaggcttcccctgaagaatattacaaactcttcctctctttaagatctgctgggtaggaaagatgggagaaaatgaattaatgtttacacagaaaggaggataatgggggcaaaaataatagatgaacgtatgggtggatgagagaatggataaaatgataggtggatatgttgatcttggacagatgggaaatgagtggatatatcaataaacagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggacctaagtggttagtggatggacaggaggatggatggatgtgagagccccagaaggacataaggaaagatgggtggatagatggatgggcggatggaaggatatttaggaggatgaatgagcatgtgtgtggagagaggtgcccattcacactggcttgaacacatgggttagctgagccaaatgccagccctatgacaggccatcagtagctttccctgagctgttctgccaagaagctaaaattcattcaagccatgtggacttgttattgaggggaaaaagaatgagctctccctctttccacttggaagattcaccaactccccacccctcactccccactgtgggcacggaggcactgcgccacccagggcaagacctcgccctctctccagctcctctcccaggatatccaacatcctgtgaaacccagagatcttgctccagccggattcagagaaatttagcgggaaaggagaggccaaaggctgaacccaatggtgcaaggttttacggttcggtcatcctctgtcctgacgccgcggggccagcgggagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgctaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccgggctgtgtctaggcagggcagagctgggcggggcagagactggggctggaacagggcgagtgg

SEQ ID NO: 57 - DNA, 2501 bp, Homo Sapiens
ttgttgtacagaatatttcatcacccaggtattatgccgagtacccaatagttctcttttctgctcctctccttcctcccatcctgcaccctggagtcaaccacagtgtctgttgtttccttgtttgtgttataagttctcatcatttagctcccacttacaagtgagaacatccagtatttggatttctgttcctgcattagtttgctaaggataatagcctctagctccatccatgttcccacaaaagacatgatctagttctttttaatggctgcattaaatgaagttttaaagatacaacataaacaccaacctcttccccaccacaaaaatcccttgctgaatttgattacacttaaattaacgagttttgtttcatgaaagactccttggacaaacttgacagttgatggaataggagaagctgtctgtcatgtctaaagccaacaagagatcaatatctagaataaatggagatctgcaaatcaacagaaagtaggcagcaaagccaaagaaaatagcctaaggcacagccactaaaaggaacgtgatcatgtcctttgcagggacatgggtggagctggaagccgttagcctcagcaaactcacacaggaacagaaaaccagcgagaccgcatggtctcacttataagtgggagctgaacaatgagaacacatggtcacatggcggcgatcaacacacactggtgcctgttgagcggggtgctggggagggagagtaccaggaagaatagctaagggatactgggcttaatacctgggtgatgggatgatctgtacagcaaaccatcatggcgcacacacctatgtaacaaacctgcacatcctctacatgtaccccagaacttcaaataaaagttggacggccaggcgtggtggctcacgcctgtaatcccagcactttgggaagccgaggcgtgcagatcacctaaggtcaggagttcgagaccagcccggccaacatggtgaaaccccgtctctactaaaaatacaaaaatcagccagatgtggcacgcacctataattccacctactcgggaggctgaagcagaattgcttgaacccgagaggcggaggttgcagtgagccgccgagatcgcgccactgcactccagcctgggccacagcgtgagactacgtcataaaataaaataaaataacacaaaataaaataaaataaaataaaataaaataaaataaaataaaataaaataaaataaaaaaataaaataaaataaaataaaataaagcaatttcctttcctctaagcggcctccacccctctcccctgccctgtgaagcgggtgtgcaagctccgggatcgcagcggtcttagggaatttccccccgcgatgtcccggcgcgccagttcgctgcgcacacttcgctgcggtcctcttcctgctgtctgtttactccctaggccccgctggggacctgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccagtgagtacgcgcggcccgcgtccccggggatggggctcagagctcccagcatggggccaacccgcagcatcaggcccgggctcccggcagggctcctcgcccacctcgagacccgggacgggggcctaggggacccaggacgtccccagtgccgttagcggctttcagggggcccggagcgcctcggggagggatgggaccccgggggcggggagggggggcagactgcgctcaccgcgccttggcatcctcccccgggctccagcaaacttttctttgttcgctgcagtgccgccctacaccgtggtctatttcccagttcgaggtaggagcatgtgtctggcagggaagggaggcaggggctggggctgcagcccacagcccctcgcccacccggagagatccgaacccccttatccctccgtcgtgtggcttttaccccgggcctccttcctgttccccgcctctcccgccatgcctgctccccgccccagtgttgtgtgaaatcttcggaggaacctgtttccctgttccctccctgcactcctgacccctccccgggttgctgcgaggcggagtcggcccggtccccacatctcgtacttctccctccccgcaggccgctgcgcggccctgcgcatgctgctggcagatcagggccagagctggaaggaggaggtggtgaccgtggagacgtggcaggagggctcactcaaagcctcctgcgtaagtgaccatgcccgggcaaggggagggggtgctgggccttagggggctgtgactaggatc

SEQ ID NO: 58 - DNA, 2501 bp, Homo Sapiens
ccagagcctgaagccctgcactaggcgtgcggtgcctcaggagcaggagcctcacggcccccaacagaaattctgatgcccagggagacccctgtgagtgcccctgacgtctagggggcacctctggcccacccttcgaaggaggcgtgtgatgggaaaggcagctggtgtggatgccctgggacaccgcacgtgctcagaaacgcggcgggaaggtcaaagtctcagagcaagcggctgggctgctgacctaggagtgtgctcccctggcttgaggttgggcgtcctcaccggtcactctaggggcctgaccaggtctgaggaagcccctcccagctacttactgaagtagaagccgcggtccccacagacgaactggagggtgtccaccagctccccgccgcacagggtctcactggggcggtaagcagcaatgcagcacgaggcgaaggccaagaaggtgagaagcaccagcatcgacttccccattgggattcccattggtgtctgggggcgggagagaagtggcgtgagcggggcagccaggccaagccccaggccagaggtgcccctcccaaaccaaatttgccaacctacaaattcagttgaaaattgaaagcacggctttcctataaacattatttttattacaaaagtaacacacaggtcataatgccgaggtgagggcgcagggccatgtgcagaatgaagcgtccagaagcacacagaaaaggcccagttccttccatttgcaagaagcactagtaattttacacgaggggtgaccatctccacggtcattattgcaggagctcagcggcatccacagctgcaggggcccaggctggacacccgacctggcctccgtcctatgacaccatgggggcagggccagcccagcgtcacatcgccacttctcaggcctccagcgccagccaagatggcagacagccccacccctacagagcatgtgcatccaggaggaccagtcccttcctccccacaacccccagctgagcagggggggtccaggaggaccatcgccctcaaagcagcaggccagtcctgctgggccagccccgcccctccccctggcttttccacctttccagtctgcagctgagccaggcctgggtcaaggactccaatggttaacacaaccacgccacccatgctctagaaaccttgttttcccagtcacccagttctccaactccagtctgccttgggtacccccaaacacacacacacacgcccagagcctcctttccaggcctcaaatcgaaccagtaaggccaggggcctccagaacatctccctatttgcgctaccaaactctccccgtgggagctggagagaccagctcaggccacctgggaagtccgacaccaggttccccagactacaatctggaaggggaggccagtcttaggacacaccccctccacaggctgcagggccacagggccgggttaacccactcgggggtgggaggccgggagccaccacagcaagttggccctgcccctgcagaaggtggaaccctccaggcgggcagccccagccttcgctccgcagacccaggggagtttttgatgcaataaattatgtgagcgactgagcaggcagtgggacagaagcacaactttgcatgccctctctaaagactagtgggcagctgcgccgaggatctgaaagcctccttggtcatctccttgactggaccctggccagtcctctcaccgccccctctgccacccccttccaaattctaagagcacactccgccagctggccactctagccctcgccgcgcttccgcaacaagccccaccactctgaacttggaggtccgggtcaggggaccggcagaaagcaggacaggaagcatgcagcggtgcggagcaggtgagggcccaggaaaagtcctgagctgggcaaggagggggccgaagggaaggaacagaaagggaaggagcaggtgagggagcagagaccaggtgggggcaggggcagaggaaaagaggggaggggggtgctgtccgagaggcagcgggctggcggctgcagggcccgaggcccaggcgtgggccgtgccccctgctgccctgcctcaggctggagtgggatggcagcgggggtcctcactccacagccctggttacctacagctcagcagaaggctcgctggggcaggaggaggaggaggaagaggaggaggaggaagctggaagtctctttcacaggagaagctaatgtccagtttgcaggctggtcagtgcctcagcttttatgtgtgagccgactcctcccagcccgggctccaccctaccccccacccctctccctgctgaccactcccccgcgcctttgctcccgccctctccctcctcccagccagtctcttctctcctgcacccccaaccgggagccctggaccatcccgtagcgaagtgccatgggctcccatcctgcacccccggctcatctctgcacagggc

SEQ ID NO: 59 - DNA, 6009 bp, Homo Sapiens
atacagcatcggtctttgtctctgggtctctcccttactcgcgctcacacacccgtaccccaatcaacacaaacagcccaagctttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggccgggtttacgcgcgaaggatgggtgccagggaaactgacttatagacgacccgctccgcgagagactgacaactcagtcctgcgggctttcggggcgcccagaccagtccttagccagaggatctggggctgcacagctcccggaccctggagggggtggtccgggggtgggagactgcgagcatcagcccacgccggccccctcccaccctgcggcggcgaggtgggaagggccaggatgcgagcttagcacctcccctagaaatgcagcacttcgcccccccacctcccctgccctcggcgctccctctttcacgcgctccctcccgcctccttcccaagggcgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccaggtaagcgcgggattcccagttctgcctgtcctcccccctcccagctcagcgtgccgggctctgcccccgacagtcgcccggtgatctcggcctggagaccccctcctgtacccaggaatctccctttctccatccctcccagccctgcgcggggacctacgcccccaggcggtgttttccgccctaacccacgctccctcccaacggcaccagctgcaagaccgctaggctgaagttcggtctgagacacctgtccggagacactgcaaaagtgaaggaaatggggggagggagcaggaagcgatgagaaagaaagaaaatcaggattggagggcacggtttggtcttggactctggaacggattcacagctgcatttttgggaggaaagaagaaggggaaatcgctgaggtcggagtctcctccccccgcacacacgcatagacacgcacacgtatataggcaggcacaccacatgcccacagccccccttcccacgaacaaaggcgcaggcacaggcgcacacgacatgtatctatatatagaccacagtactatccccaaatgcacctgcgtacacccctacagctccacaaacaaaagcatatacctgcacataccaaacacacgaatattcgtttgaacatatgcacacacacatgcacagatgcatgcagacaggaaccagcctgctcccttgggtgcggccctgttggagacatacaggtatacacacacgaaagcacacacatgctcccacacaaacacatttagtccgcaataatccagcattacctgtgcacagactcgcccctctcgcccgaaatcccggctgcaccgcaaagaggcggccagctcctccccgtgtgaccctggcgaagccctctccagaggctaagaatggcccctgctctctaggccctctccccttattcctaaccccccactccccaccaggcggcgcaggactcctacatagggagcaggtttggagtcttggcaacgacctccgagctagcaggggctggcaggccgcagctttctgggccgaaggagacttcagctctaggcaaccccggtcccttacagcttggccccgcggcgtccctggagcgcactatcactggggccacggaaggcaggttttctgggagcagaggcctcccaggggttgttccatgtatcggggtaagcaggactccaccgggccccgaacaccagatggcccgacccaaggcgctttccgctccggggcccggcgagacggccttgctggatcacggacccggggctgctcccgccttcgctgtgccccgcgacttcccggggcgtctttcaaggctccgtttgataggccccaagggaggccagggcaggaggctggaggctcgtaggcctccgggaccctggatttcgttagctcttagtccccgtgtggattctaaaccctacagccctgtccgcctgaccctgaagcttctggttctagactcttgctcggttcggctttctggcctccctggcgccttcccgccaagctcctcctcctgcttgcctccccagcctccacttagtccccttccttaggtctcgccctcgcctcactctaactccagccttgtcctaagactctcaatttccagccctgcttcctcctccccgcgcgctgctccccaagcgtcttcacattgtctctgttcttgcctcccaggggctttgccccaccttcagcccctctccctctctaccctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacctttccttctcagatccgtccatacatccctccctctccatctctggctcgacacccgggctcactattagttcccctacatccaccccgcagcctgctcttaacctctcctccccggcggctcagacccaattctcagtgtccttagcgcccccttcgggccacagcgttaagccacgccccccgggcccctcatccgttgccaagttcgctgagcgtccgcgtctggttgcctctccgccccacagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtg

SEQ ID NO: 60 - DNA, 2299 bp, Artificial Sequence
  chemically treated genomic DNA (Homo sapiens)
gttggttatggggtttcgattttgattataaggttagggattcgtttgggattagtggatagatgtttttagtaaagttattagggttttaggggttagataggaaatttttttttttttttttttttttgtggtttttttgtttttattaagatagtttttaggatttgggggatagttagtttgaggtttttttttaaacgaaagaagtttagtttggtttttaggaagtgtgtggatatttttggagttgttgttttttggagtgggtttgtgattttagagttttatgtttttagtgttgggatggggaggtttggggagttaggttaggtgggggtagtttttatttgggggggtatagtaggtagcgttagttcggttaggagttgtaggaagtaagggaatagttttatgatcggtatttttttagacgtttcgagttagggggtttcgagggaaaattattatgtttatttttcggggagtttttggtataggaggagaagagttgagtggggggttggacgttttttttattgttgtttcgaggtttcggtcggtggttcgagtattttttggaagttttgcggagttaggagttcgtaggtaaggttgtggttggggaattcgacggggagcggttcggcggggcggggcgtcgaggggtaggcgggtttcggggatggttcgtcgggcgtttagtgttattttaggttttttcgtagttgggcggtcgttcgtcgatgtagtttttttcgtagatagtagtttttttttgagattgtagtcggttcgcgtttgggttttagggattgagtcggggcggggtttcgggtcggtttcgtttatcgtagacgaggttttcgagtcgagttttcggagcgttcggttagttcgtagcgttcggttagttcgtagcgtcggagttcgtagtgcgtgcgaggggttttcggtaggtttagacgtttcgtcgagtttagttcgtagtttttcgggtcgcgtcgcgttcgtttatagggtttatagttttgtttcggtttttagggcggttatttgggatgggggtatttaggagtttagcgttagtcgttaaggtttatgatttaatcgtttttgtaggaagggtcgttcgggatgtttgggaaggtagttatgtttatatttttagggggttaagggatttttagttaggttatatagatgaagaaatcgaggtttcgagagtatttttgtttgtatatgtcgaatggatataggtatttttggaaagtgtgtgtgtgttgtgtgtgtgcgcgtatttgtgtgttcgaggaattggtagagataaaatttaagtttacgtgattttagaattttaattcgatttattatttttttagttaggtacggatatagtgggttttttataggaaattttttagggtatttggttggaggattaggtttgttgtttttttgggaagtagtttttttaggttttttttgcggggtagttttttgtggtagagagtggttttatttaggtatttttttttggtttttggtcgaggaggaattgtacgttgcgcgggggtttgtgtgtatttgcgcgtgtgtatgggtatttgcgggtttgtgaatatttatgagcggtgtatttgagtttttgtgtggtttgagtacgtgtgattattgtatttttaaatacgtttttgtgtgggggttaggtttttttgtatttttgtatgtttgtgtgatttgttcgtgttcgttgtgtatttgggtgtgtttggaagtgtttgaatgtgtatttttcggtgggattgtgagtttgtacgtttgtttgtttttgcgtgtgtgtgtttgtttttgtgggtgaagattgtgtttttttttttgcgtttgtgtgtgtttttttttggttttggatttttttttattattattttttttattgttttttgtgtttagtttttaggttgtaggaatttggtaggattgggagttacgagttggttgggtttggggttggtgggtggttgtgggggaggagcgaggtttgggaagtggtttttatagtttatattttagttaagagtagggaggttagggtagttttagtttttattttagtgatttttgcgtttattgtttgtttgtttgtttatttacgaggggttgttagagatgtagtttgtttgtttggtcggttttaagtttggaggtttaggaggcgggggttagttattagttggttaagcggggtttgtaaggaatattttgacgagttttaaataagttggggttcgtggggtag

SEQ ID NO: 61 - DNA, 2299 bp, Artificial Sequence
  chemically treated genomic DNA (Homo sapiens)
ttattttacgaattttagtttgtttgaagttcgttaggatgttttttgtagatttcgtttagttagttggtgattggttttcgttttttgaatttttaggtttagggtcggttaggtaggtaggttgtatttttggtagtttttcgtgggtgggtaggtaggtaggtagtggacgtagaggttattggggtgagagttggggttgttttggtttttttgtttttggttggaatgtgagttgtaggggttattttttaggtttcgttttttttttatagttatttattagttttaggtttagttaattcgtgatttttagttttgttaggtttttgtagtttgggagttggatatagaaggtagtgagaggagtggtggtaaagaaagatttagaattaagggagggtatatataaacgtagagagagaggtatagtttttatttatagagatagatatatatacgtagagataggtaggcgtgtagatttatagttttatcgaaagatatatatttagatatttttaaatatatttagatatatagcggatacgaatagattatataagtatatagagatatagagagatttgatttttatatagaggcgtatttggaggtatagtagttatacgtatttagattatatagaggtttagatgtatcgtttatggatatttatagattcgtaaatgtttatgtatacgcgtagatgtatatagattttcgcgtagcgtatagttttttttcggttagggattaggaggagatgtttgagtgagattattttttattatagggggttgtttcgtagggagggtttgggaagattgttttttaaggaggtaataggtttgattttttagttaggtgttttgagaggttttttgtgggaggtttattgtgttcgtgtttggttaggagggtggtaggtcgggttagagttttggagttacgtaggtttgggttttgtttttgttagtttttcggatatatagatgcgcgtatatatataatatatatatattttttaagaatgtttatgtttattcgatatatgtaggtaggggtgttttcggagtttcggtttttttatttatataatttggttaggaattttttggttttttaggggtgtgggtatggttgtttttttaggtatttcggacggttttttttgtagaggcggttagattatgagttttgacggttgacgttggatttttggatgtttttattttaggtgatcgttttgagagtcgaagtagggttgtgggttttgtgggcgggcgcggcgcggttcggggagttgcgggttgggttcggcgaggcgtttggatttgtcgagagtttttcgtacgtattgcgggtttcggcgttgcgggttggtcgggcgttgcgggttgatcgggcgtttcgggaattcggttcgggaatttcgtttgcggtgggcggggtcggttcggagtttcgtttcggtttagtttttgaaatttaggcgcggatcggttgtagttttagaagggagttgttgtttgcggaggaaattgtatcgacggacggtcgtttagttacgggaggatttggagtggtattgggcgttcgacggattattttcgggattcgtttgtttttcggcgtttcgtttcgtcgggtcgtttttcgtcgggttttttagttatagttttatttacgggtttttgatttcgtaaggtttttagaagatgttcgaattatcggtcggggtttcggggtagtagtgagggaggcgtttagttttttatttagtttttttttttttgtgttaggggtttttcgggggatgagtatggtggttttttttcggagttttttggttcgggacgtttgagaagatgtcggttatgaggttgtttttttgttttttgtagtttttggtcgggttggcgttgtttgttgtgtttttttaggtaagagttatttttatttagtttggttttttagatttttttattttagtattggaagtatgggattttgaaattatagatttattttagggagtagtaattttaaggatgtttatatattttttaaaggttaggttggatttttttcgtttgggaagagattttaggttggttgttttttaggttttgggggttgttttggtgggggtagggaagttatagggagggagggagggagggaggttttttgtttggtttttggagttttggtggttttgttaaaagtatttgtttattaattttaggcgggtttttggttttgtggttagggtcgaggttttatggttaat

SEQ ID NO: 62 - DNA, 2428 bp, Artificial Sequence
  chemically treated genomic DNA (Homo sapiens)
atagcgatttgagaaagttgtttttaagtttttttttttttttgattgtatgatattatttttataattatatttttaaagtttgttttttttaaatattataagatttatgtaatttaagtagtgattttaggggtttttgtatattttatattaattttagaaatatgtttatgattattttattaaaattattaattgttatataaatatttgtttttttatgagttgtaaaataattgttattatttttatttaattaattattttgtatttttttttgattaatttttgaaaaataatatttaatattaaaggtatttttttttatttagggttttagatagtaagacgttttttttttaaatagtaagacgtttttttaagttttatggaaagtatttttttgatattagtttggggaggtcgaattttggagtttttattcgaagagtaaagtatcgtatttagtaatgcgcgttttgggaattaagtttaagtagttttggtcgttttttcgtttaggttggtattgtttgtgttcgttagttttttcgcgaagttagtttatttgcggattaggttaaatttttggagattttacgtagacgcgggtgtagtttgttttgggatttgaagttcgttggagtttgagtttttgtattattcgggtggagttttttttgttgttgttaaaggatttcgtttggatgtttatttcgttatcgtcgtttatttcgtagttgtagaatggtagtaattgttatatatttaagtaatttggttggttattcgttttgtagttttcgttagcgcgttgtttaagttggtaattaaaagtttgggaaagcgcgaaagcgttacgtgtttcgtatttcgtttagttgtcgcgtagtttttttttggtttttattgggagataggggatttttatgagaaggaaggagtagggtagtgattgtttagtttattttgggacgcgggagttgttttcgtggattgagtggcgcggagaggggattattgagatcgggaagggttatttagataaataaggaggggtgcgggtgggcgcgtagtgtttttcgttcggtttttagatttattcgcgcgcgcgtaggcgtgtgtttttattttttttttttttttattgtttggagtgatgataattggtttttaaagtggatgagagatgagttatttatatttaatgagggaaaaatagtttttagagatttttcgtttattggttagtgagagtgttaatttttaggtttttgtcgtacgcgggcgagtttttttaggcgggaaaagtttagttgagagatataagagagtagattttttagtatttgtgaatttagagcggtgggtattgacgggtacgtgtatcgtgtggatagattttttagttttatgagtggttttttttttttcgggtcggatttggagtttttaagaggatggttgataagggtagtaggtagaaggattttagtttaaagttaaggaggttttggatggggagttgggtagtcgttcgttgtaatttttttttcgttttagttttaaaggttaagagttgtatttttgaaaagatatttggagattatttgggtgtttttgaattttaagagggtcgtttgattttggtgggttttttttttattcggtgtttttttcgttcgtagaaggagattaggttcggttaagtagagtagaaattatttattgattaaggaatggagtaggagagtttttgtttaaagtgtttggggtgtagtgtgggggtgttttttaaggttttttagggtacgtagttggaaagtaaggatttttggaaagagatggggttttttagaattagttgagtgtggtagttttttatttgttgttgtcgtttaatattatatgtgtttagtaagttgtatttttttcgtaggtatagattgaggtatggtaattagtaattgaggatttaggttagggtagcgtttttaagttcgttttttattttgtagtacggtggttattgatatttagtttttgtttttgtaagtaagtatagttttaagtataggttattttaattggttttggggttttaggaaagtattgaggttattttgcggtgatagaggtagttgtttaaagaatttggtgcgagtttgaggtaggggttgtggagtgaggtaggtaaaaatgtagattttatagttatatttcgatatattgaattagagtttgtgagggtgggatttggaattttttttaaaaagtttagaggaattaatttatacgaataataaaagttttatttgagttaaagattttaatttagaaatgagaaaacggggatttttaaaagggttatagggagagggttggaggaaagttagattatgatagttttagggtggtttttttt

SEQ ID NO: 63 - DNA, 2428 bp, Artificial Sequence
  chemically treated genomic DNA (Homo sapiens)
ggaaagaattattttaaaattgttatagtttaatttttttttaattttttttttgtaatttttttggggattttcgtttttttatttttagattaaggtttttggtttagatgaaatttttattgttcgtgtgaattggtttttttgagttttttaaaaaggattttagattttatttttatagattttgatttagtatgtcggggtgtggttatggaatttgtatttttatttgttttattttataatttttgttttaaattcgtattaagttttttgaatagttgtttttgttatcgtaggatgattttaatgtttttttaaagttttagaattaattaaggtaatttgtgtttgaagttgtgtttgtttatagaaatagagattggatgttagtaattatcgtgttataagatgggaaacgaatttagaagcgttattttaatttgaatttttaattgttaattattatattttaatttgtgtttacgggagaaatgtagtttgttaggtatatgtagtgttgggcggtaatagtaaataggagattgttatatttagttggttttggaaagttttatttttttttaggaatttttgttttttaattacgtgttttaaaagattttaaggagtatttttatattatattttaggtattttgagtaggagtttttttattttattttttgattagtgaatagtttttgttttgtttaatcgaatttggtttttttttacgggcgagaaaggtatcgggtagggaaaggatttattagggttaaacgatttttttgagatttaggaatatttagatgatttttaagtatttttttaggagtataatttttggtttttgaagttgagacgggaagggaattataacgggcggttgtttagttttttatttaaaatttttttgattttgggttgaggtttttttgtttattgtttttgttagttatttttttaagaattttaggttcgattcgggaaaagaaaaattatttatagaattggagagtttgtttatacggtgtacgtgttcgttagtgtttatcgttttggatttataggtgttggaaagtttgtttttttatattttttagttgaatttttttcgtttagaagggttcgttcgcgtgcggtaggagtttgggaattgatatttttattggttaatggacgaagagtttttggaggttgttttttttttattggatgtaaatgatttattttttatttattttggaagttaattattattattttagatagtgaagggaagggaaggatgagagtatacgtttgcgcgcgcgcgggtgggtttgaaggtcgggcggagggtattgcgcgtttattcgtatttttttttatttgtttggatgatttttttcggttttagtgatttttttttcgcgttatttagtttacggggatagttttcgcgttttaggataaattaagtaattattgttttgtttttttttttttatgggagttttttgttttttagtggaagttagggaggagttgcgcggtagttgggcggagtgcgaggtacgtggcgttttcgcgtttttttagatttttgattgttagtttgggtagcgcgttggcgggagttgtagggcgaatagttagttaagttgtttaggtgtgtggtagttgttgttattttgtagttgcggggtgggcgacggtggcgggatgagtatttaggcgggattttttggtagtagtagagagagttttattcggatgatgtagaggtttaggttttagcggattttaagttttagagtaggttgtattcgcgtttgcgtgaagtttttagggatttggtttgattcgtaaatgagttaatttcgcggaggggttggcgaatatagataatgttagtttggacgaggaagcggttaaaattgtttaggtttggtttttaggacgcgtattattgagtgcggtattttatttttcggatgaagattttagagttcggtttttttaaattgatattaaagaagtgttttttatgggatttgagaaaacgttttattgtttaaggaaagaacgttttattgtttgagattttgaatagaaggagatgtttttagtattgggtgttattttttagaagttggttaaagaaggatataagatggttgattaagtggggatggtgataattattttgtaatttatagaaggatagatgtttatgtaatagttgatagttttggtggaataattatgagtatgtttttgaaattaatataaaatatatagagatttttaaaattattgtttaaattatataggttttgtggtgtttggaaagagtaaattttggaagtataattgtaaaaataatgttatatagttaaggagaagagaaaatttaaggatagtttttttaaatcgttgt

SEQ ID NO: 64 - DNA, 2485 bp, Artificial Sequence
  chemically treated genomic DNA (Homo sapiens)
tttttgtcgttttttttttttaatttagaatttattaaagatagttaaatatgttatttattttaaattaattatttaagagatattatttttgttagtttatttttagtttttttatgttaatatttttaagttagagtatatatgaaattttttttttttgtttattattaagtttttttggttaggtgtagttgtttatttttgtaattttagtattttgggaggttgagataggaagattgtttgagtttaggagtttaagattagtttggataatatagtgagattttatttttataaagaattaaaaaaaaataagttgggtatggtggtacgtgtttgtagagttagttatttaggaggttgaggtgggaggatcgtttgtttaggaggtcgaggttgtagtgaattacgatcgtattattgtattttagtttggatgataatagagtgagattttgtaggtaattaagtaagtaagtagtttttttaatgttttgataggttttgagtcggttaaatgtaagtgatggtgattgatttttttgttatagtaagttttgaataaataaagtatttgggtggttttttttttcgattttttttatttatttatttgtttattaattatatattagttgtgttttatttgttaggtagtggttagtattgggaatatgtggaagtaaatagtttttgtttttaaggatattttgtttagtgggatagatagatagatatatacgtataatagtaatttaacgtgttaagtgaaataataggtatgtataaaaaaggtgtagtaggttaagtagggtttttaggggaaggcgatttttaagatgggtggtaagggatgagtaggaggtgatttggttaagaggttgggacggttatttaaggtaggtggaggggtagaatgagtaaaataggacgcgttgttggagcgtggtaaggaaggtaagtagcggtagaggacggcggtagggcggatcgtggggcgtaatggatgtgttacgttggaaagagtttggattttatgtcgtttttttggaaatgagataacggttggtgtaagtaagaaagaaatatatatatatttacgcgcgcgcgtcgttttttttgtgttattgtaaggttaaggagggcggcgatatagaaatttatgatgattggtataagtagatatttaatgaatgaatgaatggatataagtattttggtgtaaacgttattgttttcgatttttgtttttttacggggtaagatagtgaggtcggggtattagtttgggaggtgatagggaaggtttaaggtgagagaattgttattttggtagggagggttagtgggtataaaattaataataggttatgggtaagggatgcgtttcggtcgcgaatattttgaatttatttatcggagttattttgttttaggagcggtcgtggagaaagtaattagtcgagagttcgcgttttagggagggaagcgggtatagggtcgtttagcgttatttatttgtgagtttttcgcgggttttgtaggcggagtttcggtacgacgttttttcgattgggcgcggtttaaagtttcggggcgggtattagaggtcgagcgttttaggggattggttattttggcggacggacgtgttgttgatcgagttggttcgttttcggttcggttcgtggagagtcggttttttcgtgagttttttgttagttattggttttttgcggtttttttggggacgtggcgtcgtcgtcggtcgggtttttttttcggttgggtaaggggtcgcggggagtagttcgggattgaatcgagaggtgtcgaaggaatcggcgggtcgtttgatttcgtgagtgtgggcgcgagagggttgtgggattcggagggacggggagaggaagcgggatttatatttcgttatttggggacgatcggtttttagaggatagagttggtttacgagaacgtttcgtttttaggatgttcgggtagggttttttgggtttgaggaattagagtagacggagcgggagtttggggaggaggtgggagtcgtggaattttcgtgtaggtttgtttcgtgggtttagtcggatagaagtttgaaattaaatttttttaggttgtagacgtaggagatgtttgggataaggaggttatttttttagggtaaaagaaaaagaaggtgataggcgttgagattatcgaagggaatttatggttaggtaaggttgtatatttttttttcggttgggagtacggtagaggatggtaggtaggttggggggttttgggaggttgttttaagtgaggtttgttttggagttgtatttggattttgtattttggttagttggatgtagagacgattaaagttgtattatttcgagggttgataaataatagtttttagtttatagattaggagtggtagagtgagtcggtttgtttagttttgtaaagtgta

SEQ ID NO: 65 - DNA, 2485 bp, Artificial Sequence
  chemically treated genomic DNA (Homo sapiens)
tgtattttatagagttgagtaagtcgatttattttattatttttggtttatgggttagaaattattatttattagttttcgaaataatataattttgatcgtttttgtatttaattaattagaatataaagtttaagtgtagttttagggtaaattttatttgggatagttttttagggttttttaatttgtttgttattttttgtcgtgtttttagtcggagggaaagtgtgtagttttatttagttatgggtttttttcggtggttttaacgtttgttatttttttttttttttgttttgagaaggtggtttttttgttttaggtattttttacgtttgtagtttagaaagatttgattttaggtttttgttcgattgagtttacgagataaatttgtacgggaattttacggtttttattttttttttaggttttcgtttcgtttgttttggttttttaggtttaggggattttattcgggtattttgggagcggggcgttttcgtgggttagttttgttttttaggaatcggtcgtttttaggtggcggggtgtgggtttcgtttttttttttcgttttttcgggttttatagttttttcgcgtttatatttacgggattaagcggttcgtcggttttttcggtatttttcggtttagtttcgagttgtttttcgcggttttttgtttagtcggaaggagggttcggtcggcggcggcgttacgtttttaaggaaatcgtagggagttaatgattgatagaagatttacggaggggtcggttttttacgagtcgaatcgggggcgaattagttcggttagtagtacgttcgttcgttagggtggttaattttttagagcgttcggtttttgatgttcgtttcgggattttgagtcgcgtttaatcggaaaggcgtcgtatcgaggtttcgtttgtagggttcgcggagagtttataggtgagtggcgttgggcggttttgtgttcgtttttttttttggggcgcgaattttcggttggttgttttttttacggtcgtttttgggatagagtagtttcggtaggtgggtttagggtgttcgcgatcgaagcgtattttttgtttataatttattgttggttttgtgtttattgattttttttattagaatggtagtttttttattttaaattttttttattattttttaaattgatgtttcgattttattgttttgtttcgtgagaaaatagaaatcgaagataatgacgtttatattaaagtgtttatgtttatttatttatttattgaatgtttgtttatgttagttattatgaatttttgtgtcgtcgttttttttgattttatagtaatataaaggaaacgacgcgcgcgcgtgggtgtgtgtgtgttttttttttgtttatattagtcgttattttatttttaggaggacggtataaagtttaagttttttttaacgtggtatatttattgcgttttacgattcgttttatcgtcgttttttgtcgttatttgttttttttattacgttttagtaacgcgttttgttttgtttattttgtttttttatttgttttgaataatcgttttagttttttagttaaattattttttatttattttttattatttattttaagggtcgtttttttttaaaagttttatttgatttattatattttttttatatatgtttattgttttatttagtacgttgaattattattatacgtatatgtttgtttgtttgttttattagatagaatatttttgaaggtagggattatttgtttttatatatttttaatattggttattgtttggtagataaaatataattaatgtataattaataagtaaatgaatgaatgggggggatcggggaggaagattatttaaatgttttatttatttaaagtttattatgataagggagttagttattattatttgtatttggtcgatttaaagtttgttaggatattaggaaaattatttatttatttaattatttatagggttttattttgttgttatttaggttggagtgtagtggtgcgatcgtggtttattgtagtttcgattttttgagtaagcgatttttttattttaattttttgagtagttggttttataggtacgtgttattatgtttagtttatttttttttaattttttgtagagatggagttttattatgttgtttaggttggttttgaatttttgggtttaagtagtttttttgttttagttttttaaagtgttgggattatagggatgagtagttgtatttggttaggaaagtttagtagtgaataaaaagggaaggttttatgtatattttgatttgagggtattagtatgggaaagttggaggtgggttaataaaagtagtgttttttaggtgattggtttggggtaggtagtatatttggttgtttttagtgggttttgagttgaagaaaggaggcggtaaaaa

SEQ ID NO: 66 - DNA, 2528 bp, Artificial Sequence
  chemically treated genomic DNA (Homo sapiens)
ggtttgattttcggtttttttttgttagtgtaattattattacggcgtgatttatttttttttttttaagaatgttgaacggtattattttagaggtaggtgagttatgtgttaggttttttttgatgttttttgttttttgggttagtgcgtatattatgtgagtgtgtgtgcgtgtgtgtgcgttttcgttgggtggaacgaagaggagtgtgtgtttgttttaaaaattaaatcgcgtttcgtaggtttaaaaatatatatttttttttagagttttttgataggatttttgaaattttttttttgtttttttttttgattgtttttgattttttttaggattagtgttcggggcgttaggtagaggttttggttttattgattttttagtagttagtggttttagggacgcgtttttgatttttcggggagttgttgggggtgttttttttttggaagggatggaaggggggtcgagaagatattgttttttatacgtgtaggggttaattggaaattggttttatttatatttttttgttgttgtttagttttaatttagcgtagtcgtttttgcgtttgattttagcggacgtagtgcgggatttttttttttatttttgtagagttgagggtaggcggcgtaataaattttaggtaaaagagtattagattttagaagagttgtattttagatttggcgtaggtttttttggggagaagagtttaggggttatagagaatagaggtttgaaggaagtaaaagttggcgagaggttttttttttgtcgcgaagggtgagggtaggtagagaacgcgcgaaagggtagggttttggtcgggaagtatcgtttagcgaaaggttggtaagggtgcgtagttggagcgtggtttcgggtatttttttttaggtagtcgaatttttcgtattttagttttgtttggttgatttttatttgttttgagggaggattttttagtaggattgaattagaagtgcgttcgtgtagtagttttagtatggatttgttaattttagtgtagggggaaattttttatatggagtattttagtttttattgtttggagaaaggttttagcgtgtttcggtaattcgtttattttttatttagcgtagttcgggtatttagggttaggtggcgcggtattgaacgtatggtttttagttttaggttgacgttgacgttttattgggttttgggtgtttaggatagtgttagacgttggatattgttttaagagtcgcgttttttaaatcgaaggggttttttaattagtttaatagggtttggaggaaaggtaacgttttttttttaaagggtaaatttagaggcgtagaattatggtttttaaaatttaggtagagagagattttaagttatttttgtttttaaaatatgtatatttgttgggttatttttttttttttaattttaattgttttgtgggtttaatttttttttttttttttttagggaattttattgggttcgggttttttgtttatgtagatttatttgagtcggcgataagggcgttgtagtttttttgatttttatagagattttaagatttcgaatttttagttttaattattatgttttattatagttcggtcgtttatttttttaaaagcggtaatagtagcgggatgggtgttgttagaatagaaaggaaagaaagtttagtggattgcgtgtgtttaattgtgagggagagtagtgttggttaagggatttgttttattatatttggtagaattttgaatttagaggagatttaagattttattttcgacgtaggttagagagaattatatgtatttgttttttagtttaggaattgaaaaaatgaatattgtaatttttatggaatatttgcgggttatttagattatagttgggagaagggggaatatttttttttttgtttttagttatcgggttttagtttttttgttggagaggtgaaagaaagtagaggtataaagatgttttttttatttaaagtgtttatttaaagttttttgagaatgaggagcggggagtttttaggtaattttttttgggggttttaagataaaaagagtagaaaatttagggttatatatttaattcgagggtatttttttttattttttttgggttttttttttaggaattgtgagagaaggtagggttggatttatggggacgtattttcgtagagttaataaggattttttaaattttagttgatttttattttatttttagttttttttagattttttgcgtttattgagaaggaagaattttggtagtttgtttttttataggaagtagtaaatgttattggatgtaggaatttataatttgagttttataagagtaggaatagttaggatttaatttggaaattgattgtagaaggtgttttgttttgtttgtatttagatgattaataaatttgtgtggaatagaagaatgaatggatgattggagggtttataaaatttttgtgtt

SEQ ID NO: 67 - DNA, 2528 bp, Artificial Sequence
  chemically treated genomic DNA (Homo sapiens)
aatatagaggttttgtaagttttttaattatttatttatttttttattttatataagtttgttaattatttaggtataggtaaggtagaatattttttgtaattagtttttaagttgaattttagttatttttgtttttataaaatttaggttataagtttttgtatttagtggtatttgttattttttgtaaagaagtaaattgttaggattttttttttttagtgaacgtaggaagtttggagaaagttgggggtggggtgggggttagttggagtttgggaggtttttgttagttttgcggaaatacgtttttatgggtttagttttgtttttttttatagtttttaaggaggaagtttaggaagggtgggaaggaatgttttcgaattgggtgtgtgattttgggttttttattttttttgttttggagtttttaagaaagattgtttaagagtttttcgttttttatttttaaaggattttaaataagtattttaaataaggaaagtatttttgtatttttgtttttttttatttttttagtagaggggttgaggttcggtggttggggataaaaaaaaaaatgttttttttttttttagttgtagtttgaatggttcgtaagtgttttataaaaattatagtgtttatttttttagtttttgagttgagggataggtgtatgtggttttttttagtttgcgtcggggataagattttaagttttttttaaatttaaagttttattaggtataatggggtaggttttttgattagtattgtttttttttataattgagtatacgtagtttattaagtttttttttttttttattttgatagtatttatttcgttattgttgtcgtttttaggaaagtggacggtcggattatagtggagtataatagttggaattgagagttcgggattttagaatttttatgaaggttaaaaagattgtagcgtttttgtcgtcggtttaggtgggtttatatgggtaaagaattcgagtttagtagaattttttaggggggaggaaagggaaattaaatttatagaatagttagggttgagagggaagaagtaatttaataaatgtgtatattttgagagtaaaggtgatttaaggtttttttttatttgaattttggaggttatgattttgcgtttttaagtttgttttttaagaaggaggcgttattttttttttagattttgttaagttggttaaggagttttttcggtttgaaaggcgcggtttttaaaatagtatttagcgtttggtattgttttgagtatttaaggtttagtgaaacgttagcgttagtttgaggttgggaattatgcgtttagtgtcgcgttatttggttttggatgttcgggttgcgttggatggaaggtgagcggattgtcgggatacgttggggtttttttttagatagtggagattgagatattttatgtggaaaatttttttttatattgaggttggtagatttatattggggttgttgtacgggcgtatttttgatttagttttattaggggatttttttttaagataaatgggagttagttaagtagagttgggatacggggagttcggttgtttggaaaggggtattcgaggttacgttttagttgcgtatttttgttagtttttcgttgggcggtatttttcggttaaggttttgttttttcgcgcgttttttgtttatttttatttttcgcgataaaaaaaaaatttttcgttagtttttgttttttttaaatttttgttttttatagtttttgggtttttttttttaaaggggtttgcgttaagtttagaatatagtttttttgaaatttgatgtttttttatttgagatttgttgcgtcgtttgtttttagttttgtagaaataaagggagaagtttcgtattgcgttcgttgagattaggcgtagaaacggttgcgttgggttaggattgaataataataaaaaaatgtgggtgaagttagtttttagttaatttttatacgtgtgagaaatagtgttttttcggttttttttttattttttttaagaaagagatatttttagtagtttttcggagggttaggagcgcgtttttggagttattgattattggaggattagtggaattaggatttttgtttggcgtttcggatattgattttgaggaaagttaaagatagttaaagagaaaggtaaaaggagggttttaggagttttattaggagattttgaaagagaatgtgtatttttgagtttacgaagcgcggtttaatttttaagataaatatatattttttttcgttttatttaacgaaggcgtatatatacgtatatatatttatatggtatacgtattggtttaaggggtagagaatattagaaggaatttggtatataatttatttgtttttagagtggtatcgtttagtatttttagaggaaaaggagtggattacgtcgtaatggtggttgtattggtagagaaaagtcgggagttagatt

SEQ ID NO: 68 - DNA, 2321 bp, Artificial Sequence
  chemically treated genomic DNA (Homo sapiens)
ttagttaattattggaaaggatttagtgagtttggtttattttagttttaatttgggtttgtatataagtaaaaagtaaatgttgaatttttaggtagatttttatgtagatatgtaaaattaattgtttcggtggtgaggagttatggggagtttttcgaagggttttttaggtagtgggttaatgggtaaaatgattatttagtggttttgttgatcgatggtacggatgtgttaaggatatttattagtttatttgagaatatgaaataaagtgttgagattttattatttaaagtaataaagaaatcgtaagtaatacgattgatagttagaagggaatattggagttgtggcgtgtaatgttgttttggattagtatttttaaatttcgttaagttaaaggttttgtttatttgtgagttttttatatgtatagaattaggcgtggttacgtaaagtttttggatacggtttttacgaagttgggagtcgatattaggatgtcgatggtgtagatgatggtgaagatcgagaaggttatgaggtataggcggtttattatataggcggcgaatttttattcgttgtagatcgtttcgttttcgttttggtagcggaagcggttggtaatgtagcggattttttttaggattttggttaagttcgggtttttttcggggggttgttcgtcgtgtaggaggtgtttatcgtgcgtgggggagtaggttatgcggttatatattattttagagtcgggggtcgggatatagtgtacgtcgtttaggtcgcggaagtcgatgtatagtaggttttcgttgttggcgggcggcggcgttacggtatttatttttatattggttaggttgtagcgtcgttgtttgtgttggtaggtcgggcgtattttgtttttttcgggtttttttattcgtaggaattacgcgtattagtttagaaggatgattttggtttggggagataatagaacgttaagagtagttttgaggcggatacgggttgattttaatagtagtaagattttataatataagttttgttttattggttttgggggtagtagtttttattgtttttcggatgattttagtaggtaagtagtgtttgcgtatgataagtagtcgagtttaacgtgaggtaagattaaaattgatgtattttgggaataagttaaattgtttttcggggtaggtatattgtaattttagggaagatagtttcgtggaaggggaaggttatttgagttgtgtaaagagggaaagttaatttttttttttgatttttttttatttgtaattcggggatttttagatttaattttggtttttatattatttgttaggtgttttggaaggttattgtaaattcgtaaagagtgtttgggggaggttgtatatttttaaatgtaattttaggatatttatgagatattaggtaaatttgaagtttgaagtagtttaggtttttaatattagattattatattttttgtgatgacgtgattattttgtaaagttgttttttaaagtattttgataaaaagtaaatattaaggaattttatgtgaaatagaaattaggttagtggtttttaatttgattttaagatttgagaggcggtgtcgtgttttataggtgttatattgttaaggtataaatatttattaaagtgttttgatttatttaaaaagagagttttgggtattattttttttggttaggggttttgtgaaaaattttttgagatattaacgtgttgtgaattaaggtagtttcggaatttttaatttaatttagtaggttttaatgaagatcgaataagatgatgtttgggagagtattttgaaaagttgaaggtagaagttggtaaattttttgtaaagggttaggtaattatttatttttgttgatgtagtatatattgaaggcgttaaatggatgggtatgttttttaaaataatttatttataaaaatatttggtggattggatttggttatttaggttataatttgttaatttttggtttaaagtgtgttttagagtgtatgaaagaagttggagaaaaattattatggagtttattttggttttgttttttatggaaagaagagagataattgaagttttaatttaggtaaagaagtatttttgtaagtttatttatgtaaagtgtatgaaaagtgggttttttttttgaaattatttagattttgattttatttatattttgttttatgattttggggaaattttattagtaatttaataggtttattttttatttttaggaaataaatatata

SEQ ID NO: 69 - DNA, 2321 bp, Artificial Sequence
  chemically treated genomic DNA (Homo sapiens)
tgtatatttattttttaaagataggaaataaatttgttaggttattgatggaatttttttaaaattataaaataaaatgtaaatgaaattaggatttggataattttagggaaaaggtttattttttatatattttatatggatgggtttgtaagaatgtttttttatttggattgaggttttagttgttttttttttttttatgagaggtaaaattaggataaattttatggtgatttttttttagttttttttatgtattttaggatatattttagattagaagttagtaaattatggtttaggtggttaaatttagtttattaagtgtttttgtaaataagttattttagaaaatatgtttatttatttgacgtttttaatgtgtgttatattagtagaagtgagtagttgtttggttttttatagaaagtttgttaatttttgtttttaattttttaaagtatttttttagatattattttattcggtttttattgaagtttattgagttaggttagaggtttcgaaattgttttggtttatagtacgttagtattttaggaaattttttatagagtttttggttaaaagaaataatatttaaggttttttttttaaatagattaaaatattttaataagtatttgtgttttaataatgtagtatttatggggtacggtatcgttttttaaattttgggattagattggagattattaatttagtttttgttttatatgaagttttttggtgtttgttttttattagggtattttgaaaaatagttttgtaaagtggttacgttattataagagatgtggtaatttgatgttggaagtttgaattgttttaagttttaagtttatttggtgttttatggatattttgggattgtatttgaaaatgtataattttttttagatattttttgcgaatttgtagtggttttttagggtatttaataggtagtgtgggagttagagttagatttgaaggttttcgggttatagatgaggaaggattagagagggaaattgattttttttttttatatagtttagatagttttttttttttacgaagttgttttttttgagattgtagtgtgtttgtttcggagaataatttagtttgtttttagggtgtattagttttagttttgttttacgttgaattcgattgtttgttatacgtaagtattgtttgtttgttaaaattattcgggaggtagtggaggttgttatttttaggattaatgaagtagggtttgtattgtaggattttattgttgttgggattagttcgtgttcgttttagggttgtttttaacgttttgttgtttttttagattagagttatttttttgaattggtgcgcgtggtttttgcgaatgaagaggttcggggaggataaggtgcgttcggtttgttagtataagtagcggcgttgtagtttggttagtgtggagatgagtgtcgtggcgtcgtcgttcgttagtaacgggaatttgttgtatatcggttttcgcggtttggacggcgtgtattgtgtttcgattttcgattttggggtagtgtgtggtcgtatggtttgtttttttacgtacgatgagtattttttgtacggcgggtaatttttcgagggggattcggatttggttaagattttggaggaggttcgttatattgttaatcgttttcgttgttaggacgaaagcgaggcggtttgtagcgagtggaagttcgtcgtttgtgtggtggatcgtttgtgttttatggttttttcggtttttattattatttgtattatcggtattttgatgtcggtttttaatttcgtggaggtcgtgtttaaagattttgcgtaattacgtttggttttgtatatgtggaaaatttatagatgggtaaggtttttggtttggcgagatttgggggtgttaatttaggatagtattatacgttataattttagtgtttttttttggttgttagtcgtgttgtttacggtttttttgttattttaggtagtagaattttagtattttgttttatatttttagatgggttgatagatatttttggtatattcgtattatcggttagtagggttattgagtagttattttgtttattagtttattgtttggaaagtttttcggagagttttttatggttttttattatcgagatagttggttttgtatgtttgtatgaaggtttatttgaaaatttaatatttgttttttgtttgtgtataaatttagattgaagttaaaataaattagatttattaaattttttttaataattgattgg

SEQ ID NO: 70 - DNA, 2412 bp, Artificial Sequence
  chemically treated genomic DNA (Homo sapiens)
aggtttagtgttttttgtttaaatatattggttgtttggaagtttttgagttttgtttgttggttaggtttaaggaaatgtttggaaatttgagaattagagtattggtttgggttgtggttttcggtagggagagacggtcgtttagagtagcgagtggttaggaagtgtattttagttttttatttcgttttcgtgtttatcgtaggatagagtttcggtagaaagtattttagttttaggtgaattcgagttaggataagtttcgcgtttttttttagtttagtaggtagacggagggtttgttttttttttagaacggttttttgattttagagatgtgaggataggttgcgtgggcggcgggttttttatgggagtttgggttggagagagtgttgttttttttttttttttttatttaaggttgtttttattaaaattaaatttagttttttgtattattgtgtttttggttgttggaataaaagtagagagttggggaaggtttttgatagattgggcgtgtttgtgagttttatgtagtttgtggttaatggtaggtttttttttttattttaggggagggttatagtttttcgtatttttagttgaggttatggttgggttatttcggtgattttgggatagacgtggcggggatggtagggtagcgttgacgttttggaattagttttgttgtagttagagttgtttgtggtgtttttagagggtgagtaagaattataggttttttatcgtgttattagttggtagtcgagcggttatagaagaaagcgtagacgttgtagggttttttttaagtagaggcgtttttaatatatttgtatttgtttgaatttaaagttaaaaatattggcgtcggtgtttttttttcgttattcgatttacgggtttgttttttttatgttgatgttcgttttcgttgttttttgtaggtcgtatgcgggtgttgaaggtgtagaatttttttttttcggggaggcggtcgtggatttttattttaattggtttaagttttatattggtattaatcggtacgagttgtattttagatataattcggttatcgaggttttgttgtacgattttagtttttagaggattattagcgtgggtaggtgtttttgggtgtatttagggtcgtttgtgtgtcggttgtgtggtattagggttgttggggtaggttatgtgttagagaggtttgggaggtcgttgtttattacggtagcgttattttttgtagtaatttgtacgggtagcgaggagggatagagggttcgcgtttcgtgtgtttttatattggatgtgtttttgatttgtcgtacgatgagcggggagacgtttggatagtcggtttattgcgttttgcgtttttatttgggtggtttcgggggtgttaattggatgatagagttttttttttttggggtagaggaatagaggggtatttttggcggcggtgatttttttatcggaagcgtgtgtatggaatttttttgtttttttatatacgattttggttgggtggggagatagttatgagtttgttttttgtggttttgaagtcgtttttcgttagattttagtaaggcgttgtgtagttttatattgaggagatataggtagggtttaggacggaggtttgggttttttagatggaggagtttgaaggtaatatttttaggtattttgggatttgttgaattggataaaaaagggtatttagttgttgattttaggaaaatatgttattgtagtttttgagcgtggaggtttggtgttattgtttttagtttgtaggcgattgtttgtgaaggttttatttgttattagtgtttggagaggtagtgagggcggggttgaggttttttagtgggagtagttgtttttcggggattgtagggagtgggtttgggtgtatatagttgtgggtaggtgtagaggttatgatagtttgaaggtagggttttttttgcgttgtgtgatgaggttagtagttttaggtattagttttatgtgtgttttagaagtaattttggtgttgaaagggttttagtagtttggggttttgtttagttgttgatataggatttaggtgtttttttttaggttagtaggtaggtttttttgagtttttcggggttgtttttggttttttttgtcgggtgttgagttgtttgttgggtatttatttggttatggggagatagaatttgtagttttttttttattttttgattagtttattttataatagagattagttggataagttgggagtttttttttttttatgttgtttgggagtaatttgaatttttgtttttttttaggttttttttcgtgaaagcgttgttttttttttgtttttgtagcggtttgagggtt

SEQ ID NO: 71 - DNA, 2412 bp, Artificial Sequence
  chemically treated genomic DNA (Homo sapiens)
agtttttagatcgttgtaggggtaggagaaaggtagcgtttttacggaggggggtttggaggggggtaggggtttaggttatttttaggtagtatggagggaagaggatttttagtttgtttagttgatttttgttatgaggtgagttgattaaggggtggggagagagttgtaagttttgtttttttatgattaggtgagtgtttagtaaataatttagtattcggtagagagagttagaaatagtttcgaagagtttaggagaatttatttgttggtttgaaaggggatatttaagttttgtgttagtaattggatagaattttaggttgttgggatttttttagtattaaggttgtttttgagatatatatgaagttaatgtttgggattgttggttttattatatagcgtaaagaaagttttgtttttaggttgttatggtttttgtatttgtttatagttgtgtgtatttaggtttattttttgtaattttcggggagtagttgtttttattaaagggttttagtttcgtttttattatttttttaagtattggtgataaatgggatttttataaataatcgtttataagttgagaataatggtattaaatttttacgtttagaagttgtagtggtatatttttttgaaattagtaattggatgtttttttttgtttaatttagtagattttaaagtatttggagatgttgtttttaaatttttttatttgggaggtttaggttttcgttttgagttttgtttatgtttttttagtatgaaattgtatagcgttttgttgaggtttgacgaaggacggttttaaaattataagaagtaggtttatggttgtttttttatttagttagggtcgtgtgtagaaaagtaggagagttttatgtatacgttttcggtggaggggttatcgtcgttagagatatttttttatttttttattttaggagggaaggattttgttatttagttggtattttcgggattatttaggtgaggacgtagagcgtagtggatcggttgtttaggcgttttttcgtttatcgtgcggtagattaggagtatatttagtgtgagagtatacgagacgcgagttttttgttttttttcgttgttcgtgtagattgttgtaggaggtgacgttgtcgtaatgagtaacggttttttagatttttttaatatatagtttgttttagtagttttgatgttatatagtcggtatatagacggttttgagtgtatttaaggatatttatttacgttggtgattttttgggagttgaggtcgtgtagtagggtttcgatggtcgggttgtgtttggagtatagttcgtatcggttgatattaatgtggaatttgagttagttgggataggagtttacggtcgttttttcgggggagaggaattttgtatttttagtattcgtatgcggtttgtagggagtagcgaggacgaatattagtatggaaagaataggttcgtgagtcggatgacggggagagggtatcgacgttagtgtttttaattttgggtttaagtaagtgtagatgtgttgaaggcgtttttgtttaaagagggttttgtaacgtttgcgtttttttttgtggtcgttcggttgttaattaataatacggtgaaaggtttgtaatttttatttattttttggagatattatagatagttttaattatagtaaaattaattttaggacgttagcgttgttttgttattttcgttacgtttgttttagggttatcgaaatggtttaattatgattttagttgagggtgcgaggggttgtggtttttttttggagtagaggggagaatttattattgattataggttgtatgaaatttatagatacgtttagtttgttaggaattttttttagttttttgtttttgttttaataattaggggtataatgatgtaagaggttaaatttgattttaatgagagtagttttgggtggggagagaggaaggaggtagtattttttttagtttaggtttttatggaggattcgtcgtttacgtagtttgtttttatatttttggggttaagggatcgttttggaggagggatagatttttcgtttgtttgttgggttggagggaaacgcggaatttgttttagttcgaatttatttaaagttgaggtgttttttgtcgaagttttgttttgcggtggatacgggggcggggtggggggttaggatatattttttggttattcgttgttttgggcggtcgtttttttttgtcgagagttatagtttaggttaatgttttggtttttaaatttttaagtatttttttgaatttgattagtaggtaaggtttagaggtttttaaatagttagtgtgtttagatagaagatattgggttt

SEQ ID NO: 72 - DNA, 2225 bp, Artificial Sequence
  chemically treated genomic DNA (Homo sapiens)
gtatgtatttttatggattaagttgggtttaagttttagttatatgtagattgggaagatgtttgttaggtaagtgttgagggtaggtttattattgattgattgtggtagatttggtaatagtagttgttatttatagtagtggtaatttttcgtattttttttttcgaaattaggatatgtttggcgatgtttggagatattttgggttgttataattaaggacggtgtttttaattttagtgggtagtagttagggatgttggtaaatattttagtatgtataggagggttttataataaagaatgatttagttcgtaatattaggaatgtcgaggttgaggagttttgtttcggagtattgatttatgttatatgttgggttttaagagtttgtttaatttatataattttgtatggtgggtggttatttttattttttagatgaggaaattaaggattagagaggttaagtaattgattcgaagttaaatagtttatgagtggtagagttttatttaaattttgagtatatgtttttagttaaagttttgtatttggtagataggtttaacgataatgtatgatgataattagtttgggtatcgcggtggagtgtcgtaggtttttaatagtatggagtaggtgaaggggttttgtaagttgtgtaaatgatgatgttgttatcggttatattattgggtgagttattgtgtaagaatcgtatttaggttatatttttgcgtttttagtagttgttcggtttttggttttagagagtttcgattttattttttttgtgaagatttggttagtattttttcgtgagcgttttttattttgtcggtatagtggataatgtagaaattagttttgttttttagttgtttgggtttttggaatttggggtgggtgttttgtttttgtattattttttttacgaagtttttgtcggtggttttggggaattagtatttttcgtttagtagggttagaatgttcggggggtttgtttggaggaagcgtagtattagtataggtgagtgtattttgggaggggtattttattttttaagaagttaaagttcggatattagaattttttgaattttatagacggtgggcgatatattttttaggagaagtaaagtattgttgaagatttttagtttttaaagaaatttttggggtttaggttgcggttgatatttttatttaaggatttatcgcggtggttttttagtattagtgaaatttttagtgggtttgatgaaaagtgtatattcgttgattcgcggggttagagtttgattttatagtgtattggggtttgtttaggaggttgtttttaataagtattttgtgattttgttacgggagatgttaatttatatgttttgcgtttgtatgtttatgatgagatgggatatgtaggaggagttttttgaggaagatagttttagggatttagtagttttttgtatattgagtttataagataagaaagtaggtttggatattgtagagaggttgataaaatttgaagtttagtgggtttttattagttggaaaatttaattgattaaagaaaaaagtttattataaaagtaaatttttggttaggcgcggtggtttacgtttgtaattttagtattttgggaggtcgaggcgggcggattatttaaggttaggagttcgagattagtttggttaacgtggtgaaatttcgtttttattaataatataaaaataagtttgtaattttagttatttaggaggttgaggtaggagaatcgttttaaatagggaggtaaaggttgtagtgagtcgagagtacgttattgtattttagtttgggcgataagaataaaaatttgttttaaaaaaaaaaaggaaattttttttaaattgaaaaaattttgttttaggttttttgattaattaattataattaaaagaaaatttagagataggttaggcgcggtggtttatatttgtaattttagtattttgggaggtcgaggagggtaaattatgaggttaggagattgagattacggtgaaatttcgtttttattaaaaatataaaaaaattagttgggcgtggtggcgggcgtttgtagttttagttatttaggaggttgaggtaggagaatggtatgaattcggaaggcggagtttgtagtgagttaagattaggttattgtattttagtttgggcgat

SEQ ID NO: 73 - DNA, 2225 bp, Artificial Sequence
  chemically treated genomic DNA (Homo sapiens)
gtcgtttaggttggagtgtagtggtttgattttggtttattgtaagtttcgtttttcgggtttatgttatttttttgttttagttttttgagtagttgggattataggcgttcgttattacgtttagttaatttttttgtatttttagtggaggcggagttttatcgtggttttaattttttgattttatgatttgtttttttcggttttttaaagtattgggattataggtgtgagttatcgcgtttggtttgtttttgggtttttttttgattatggttaattgattagaaggtttaggataaagtttttttagtttgaaaaaaattttttttttttttttgagatagatttttgtttttgtcgtttaggttggagtgtaatggcgtgttttcggtttattgtaatttttgtttttttgtttgaagcgatttttttgttttagttttttgagtggttgggattataggtttatttttgtattattagtagagacggagttttattacgttggttaggttggtttcgagtttttgattttaggtgattcgttcgtttcggttttttaaagtgttgggattataggcgtgagttatcgcgtttggttaaaaatttatttttgtaatgagtttttttttttaattagttgaattttttaattaataggaatttattgggttttaagttttgttagtttttttgtagtgtttaaatttgtttttttgttttgtaaatttagtgtgtagaaggttgttgggtttttgggattattttttttaaggggttttttttatatattttattttattatagatatgtagacgtaaagtatgtgggttggtatttttcgtggtaggattatagggtatttgttgagggtagttttttgggtagattttagtgtattgtgaagttagattttggtttcgcgggttagcggatgtgtattttttattagatttattgagggttttattaatgttggagaattatcgcgatggatttttgggtaaaggtgttagtcgtagtttgggttttagaggtttttttagaagttagaaatttttaatagtgttttgttttttttggggagtgtgtcgtttatcgtttgtgggatttaggggattttgatgttcgggttttggttttttgaagggtggggtgttttttttagggtgtatttatttgtgttgatgttgcgttttttttaggtaggtttttcgggtattttggttttgttggacgaggagtgttggttttttaaagttatcgataagagtttcgtggagaaggtgatgtaggagtagggtatttattttaagttttagaagtttaagtagttgaaggataaagttgatttttgtattatttattatgtcggtaaggtgaggagcgtttacggggaggtgttggttagatttttataggagaggtggagtcgaggttttttaggattaggagtcgggtagttgttggggacgtaggggtgtgatttgagtacggtttttgtataatgatttatttagtaatgtggtcggtgatagtattattatttatatagtttatagagtttttttatttgttttatgttgttagaagtttgcggtattttatcgcggtgtttaggttggttgttattatgtattatcgttgggtttgtttgttaggtgtagagttttggttaaaggtatgtgtttagagtttgaatagagttttgttatttataagttgtttgatttcgggttagttatttaatttttttgatttttggtttttttatttggaaaatgagaatgattatttattatataggattatgtggattaaataagtttttgaggtttaatatgtggtatgaattagtgtttcggggtagggttttttaatttcggtatttttggtattgcgggttgggttattttttgttgtgggatttttttgtgtatgttaggatgtttattagtatttttggttgttatttattagagttaggagtatcgtttttagttgtgataatttaaaatgtttttagatatcgttaaatatgttttagtttcggggggggaggtgcggggaattgttattgttgtgggtgatagttgttgttgttaagtttgttatagttagttagtggtggatttgtttttaatatttatttagtagatatttttttagtttgtatgtgattggggtttagatttaatttagtttatagaggtgtatgt

SEQ ID NO: 74 - DNA, 2205 bp, Artificial Sequence
  chemically treated genomic DNA (Homo sapiens)
atttgtttttacgaaatggtataaaattgggttaaaagttaagggaataggtgtgttaaatttaaaagtttaagtatatcgtggagttgaatgaaaaatagttttttgaataattattattaaatgagtaaaagtttaaaaataatgtaaaaagttaaagtcggttgggcgcggtggtttacgttcgtaattttagtattttgggaggtcgaggtgggcggattacgaggtaaggagatcgagattagtttggttaatatggtgaaatttcgtttttattaaaaatataaaaattagttaggtgtggtggtgagtgtttggtggtgagtgtttgtaattttagttattcgggaggttgaggttcgaaaattgtttgaatttaggaggcgggagggtgtagtgagtggagatcgtattattgtattttagtttggcgatatagcgagatttcgttttaaaaaaaaaaaaaagttaaagtcgtttgagtaaataaaagattagataaaaattttatgaattaaaaattagttataaagttgtttaattagaataggatgaggaagaaaaggggaaatcgattatttttgattaagtgtaaattttaagtaaattattgatattaatagtgagttggagtattttgttttattaggtaattttttgtaaatattttgtaacgattttatatatataaagtttttttatgtttttttttaaaaatatgagatttttttaggttaatgtttaggtgagatgttttttgttgttttagtagtttagttttatttttttttttggttattatgaatgtttttttataattggagagttaggatgaattaatttcgagtaagaaacgggaaagtatagtaaagaggcgatagttttgtatttttatacggaaaaagatttagaggagagtagcggtatttttgttttagttttaattcgaacggaggtaggatttttaataatatcggacgtttttttttttcgtcgttttacgttttttcgacgaagaagtaaaaagtggagagtttagtcgttttttagggttacggagttttttagttagggattttttttcgttatataattaaggtttagggttttgtttttgcgattagttttttggaaggagacggacgggttttttagagatttttttagggaggtggaagcggggttttgtatttagtcgattcgggagaaagaagtgggacgatatgagggaggtcgttattaaaggcggtggggtacgggggtgatgagcgagttcggagaggggcgggcggtttcgggagtttcgtagtaggtttcggtattttcggtcgtagtcggtttttttttttcgtttgtttagtttttatcggtcgtttttttttttatttcgcgtttttttttttcgcgtttttattttcgattttagtttagcggtaggtagatttgtagggaaggttttggttatcgtcgttggatggtttttagttcggtatttggttagatatgatgacggtggttttattcgggggttttcgtatagtagcggtttcgggtaagtagaatttcgtttcggggtttataaattttttttttttttttatagtataatatcgcggttgtagtaattttcgttacgtttcgcgttattttcgtttcgcgtagggaggagggagagagagaagagaggaaagataaggcgggaaatgggtgggggagtagttaaggggaggggtaggttgtggagttgttttgtcggtggtcgcgcgggtgaacggtagttttgttagtttttttaaggattaggttttgcgtattagtattagggttattttttaggagtaaaggttttggttttatgttttaatgtttggagttatttttataatttagattgtttttttcgttatattttgcgcgtttttgacgattgagtcgagatattttttttgtttttttttagttttgtttattaatttttaatttttaaatatgtttatttgaatgttagtatttttagttttagaattaatattttcggttaattagtatttttgttaaatatatgatcgtgatttaaaataataagaaagtaacgatttaatataattttgacggttattgatgttaaagatcgttgttgaaagttttaaatggggagtgagtaattttaatttttgaattggttgttttgagttaaggtta

SEQ ID NO: 75 - DNA, 2205 bp, Artificial Sequence
  chemically treated genomic DNA (Homo sapiens)
taattttaatttaaagtaattaatttaagggttggaattatttattttttatttagaatttttagtagcggtttttagtattagtagtcgttaagattgtgttgggtcgttgtttttttgttgttttaaattacggttatgtgtttggtaagggtgttggttaatcgaaaatgttggttttagagttagaagtattggtatttaaataaatatatttgggggttgggggttgatgagtaaggttgggaggagataaaagaagtatttcggtttagtcgttagagacgcgtaaggtgtaacggagagagtaatttaggttgtgagagtggttttaaatattgagatatggagttaggatttttgtttttgggggatggttttagtattgatgcgtaggatttggtttttgaaggagttgataaaattgtcgtttattcgcgcgattatcggtaaagtagttttatagtttgtttttttttttggttgtttttttatttatttttcgttttgttttttttttttttttttttttttttttttttgcgcgaagcggaagtgacgcgaggcgtagcggaagttattgtagtcgcggtgttgtgttgtggggaagggagaaggatttgtaaatttcggagcgaggttttgtttattcgaggtcgttgttgtgcggagattttcgggtgaagttatcgttattatgtttgattaggtatcgggttgggagttatttaacggcggtggttagggttttttttgtaggtttgtttgtcgttaggttggggtcggggatggaggcgcgggggaggggagcgcggaatgggggagggggcggtcggtggggattaggtaggcgagggagaggagtcgattacggtcggaggtgtcggggtttgttgcggggttttcggagtcgttcgttttttttcgggttcgtttattattttcgtattttatcgtttttggtggcggttttttttatgtcgttttatttttttttttcgggtcgattaggtgtagagtttcgtttttatttttttgggagggtttttggagaattcgttcgtttttttttagaggattaatcgtagaagtagggttttaggttttagttatgtaacgggagagaatttttgattgggaggtttcgtggttttgagaagcggttggattttttattttttgttttttcgtcgggagggcgtggggcggcgagggagggagacgttcgatgttgttgggaattttgttttcgttcggattggagttagggtaaggatgtcgttgtttttttttgagttttttttcgtgtgggggtgtagagttgtcgtttttttattgtattttttcgttttttattcgggattggtttattttagttttttagttgtaagagagtatttataataattaagaaagaaaatagaattaaattgttagagtaataaaaagtattttatttgggtattaatttgaggaagttttatatttttgaggaaaagtataggaaaattttgtgtatgtagagtcgttgtagaatatttgtagaaagttgtttggtaaggtaaagtgttttagtttattgttagtattaataatttatttgggatttgtatttaattaggagtgatcgattttttttttttttttttattttgttttaattaaataattttatggttagtttttaatttataaagtttttgtttggttttttgtttgtttagacgattttgatttttttttttttttgagacggagtttcgttgtgtcgttaggttggagtgtagtggtgcgatttttatttattgtattttttcgttttttgggtttaagtaattttcgggttttagtttttcgagtagttgggattataggtatttattattaggtatttattattatatttagttaatttttgtatttttagtagagacggggttttattatattggttaggttggtttcgatttttttatttcgtgattcgtttatttcggttttttaaagtgttgggattacgggcgtgagttatcgcgtttagtcgattttgattttttatattatttttggatttttatttatttaatggtagttatttagaaaattattttttatttaattttacgatgtatttgaatttttaaatttaatatatttatttttttggtttttaatttagttttgtattatttcgtgagagtaagt

SEQ ID NO: 76 - DNA, 2355 bp, Artificial Sequence
  chemically treated genomic DNA (Homo sapiens)
tgttagatataatttatttaattaagtagtttttttggttagaagagacgttttgattatttagatgggtatcgtttagagtattggttttaagttaggtttagtgttagagttaggtgtcgagttttatcgggttatttttgtagagttgcggttatatgttttgttaggtgttaggaagttatatatagtggtggtgtagatgggagagggtatagtaggtattgtgattatattgtttttagaggagtttgcgggtgttttggattttatcgggatgaggtttgagagttagttggtatgttgtgatatggtttataagtttttttttggtagtagttgtattggtattttttattcggtttttagtgtgtttgagaagagtatggtagatgttgttttatttggttaaagtagtagttttttttatggttttcgggattttgagttttttgagtttttaatttatcgggtatagggggtggtggggtttgggttttatgaggagtagaggttttatttataaggtttgtttggtaggttgtatttttttatgtttgatattaatttggttgaggttggttttaattattatgtttagaggatcgggtagtttttttagggttttggacgagattcggttatggattttagtttattgaagtatttttatagtttgggttttgcggatggacgttatttagggtagggtttgtagtatggtttagttacggatttgcgttattttatagattttttggtttattcgttttttatgcggcgttatagtttagtgtcgaatatttatttagattataggtacggtttacggggagatgtagttggtttttaggaggttagtttggtttagtatagtgttattatagttcgtgaaattagtcgtatgtgcgttgtttttaattttatggattagtatggtgggcggtatggtagtggtggtggtggttttgattttgtgtagtattagttttagtacgggttcgggtttagtgttttatagagtttggttttttttagatttggattttttggtaattttatttttttagagggttatttaagttttgggaatttggtttagtatgggtttgtagtaggttaaggaatagtagttagatagttgttgtcgtttatagttattgtacgtgtagttgatggtatgatttattcgattattaatattttaattgttgtaatattgtttattattatttagtttgttttagttttgcggtttatggtgcgtggtggtatgtataggttttacgtatttggtggaattatagtcgtgttatttattagtttgatacgtgtgtttatgattgtttttcgggtattttttggatttatagggttgtatcgttattttgtattaagtagattttttattgtttttagtgttttatttgtagaagggtttgtttatttggggaaatttgttgttgttaaggtttttggggttgggggttttttaaggttagagatgttagtaggggttgtacgggaagagtttttttttataattatttttgttgttattaaggaggttgtaggagttttagtttttgttttattagttggttagaagttattagtagatgttgtttttgggggtggtagtggggtttttagtcggttagggttcgagaaagaggaagtattataggaggagaggtagcggaagtaataggagtagttgttttagttagagcgggagcgggtggagttggagaagttgcgataatttcggttgtaagaggagttagagcgggaacgtgtggagttgtagaggtatcgtgaggaggagtagttgttggtgtagcgggagttgtaggagttgtagattattaagtattatgtgttgtagtagtagtaagaggaacgttaggtttaatttgtattgtagcgggaatagttagcgtagtagcgtttgtagttggagtagatttagtagttgtagtagtagttgtagtagtagttagaggagtagaagtagcggtagaaggtttttttttttgtagtttgtgaggtatttggtcgagggttttttttagcggttgttgagttggtttagaatggttagtattggtttttttttatatatgtagtttttattgttatggtagggtttgaaggatttgggtagtttcgtgagtttgtgttgtatcggggtttttttagttttgttttagatatgttattgtaaacggaggagtagtgggaggttagtcgtagtggtattaagaagcggtattttatgttacgtttgcgggatgtttgtgagttagagtttgggattgagttttgtgtggttaggaggattgtcgatagtag

SEQ ID NO: 77 - DNA, 2355 bp, Artificial Sequence
  chemically treated genomic DNA (Homo sapiens)
ttgttgtcggtaatttttttgattatatagggtttagttttagattttagtttataggtatttcgtaggcgtggtatggagtgtcgttttttgatgttattacggttggttttttattgttttttcgtttgtagtgatatgtttgaggtagagttggggagatttcggtgtagtataggtttacgaggttgtttaagttttttaggttttgttatggtaatgaaggttgtatgtgtaagggggggttaatattggttattttgggttaatttagtagtcgttaggggaggttttcggttaggtgttttataggttgtaggaaagggagttttttgtcgttgtttttgtttttttagttgttgttgtagttgttgttgtagttgttggatttgttttagttgtagacgttgttgcgttagttgttttcgttgtagtgtaaattgagtttggcgttttttttgttgttgttgtagtatatggtgtttgatggtttgtagtttttgtaattttcgttgtattagtagttgtttttttttacggtgtttttgtagttttatacgttttcgttttagttttttttgtagtcgaagttgtcgtagtttttttaattttattcgttttcgttttagttggagtagttgtttttgttgttttcgttgtttttttttttgtgatgttttttttttttcgaattttggtcggttgagggttttattgttatttttaggagtagtatttgttggtggtttttggttagttagtggggtaggagttggggtttttgtagtttttttgatggtagtaggggtggttgtgggaagaggtttttttcgtgtagtttttattggtatttttggttttgaagggtttttagttttaggggttttggtagtagtaggtttttttagatagataggtttttttgtaggtggaatattggaagtaatgggaaatttatttggtgtaggatagcggtatagttttgtgggtttaagaggtattcggggggtaattatgggtatacgtgttagattggtgagtggtacggttgtgattttattagatgcgtaaggtttgtatatgttattacgtattatgggtcgtaggattgaggtaggttgggtggtgatgggtagtgttgtagtaattggggtattgatagtcgagtagattatgttattagttgtacgtatagtggttgtggacggtagtagttgtttgattgttgttttttggtttgttgtaggtttatattgggttaagtttttaggatttgggtggttttttggaaaggtggggttattaaggagtttaggtttgaggggaattagattttgtggagtattgagttcgggttcgtgttggggttggtattgtataaggttagggttattattattattgttatgtcgtttattatattggtttatggagttgagggtagcgtatatgcgattgattttacgggttgtggtggtattgtattgggttaggttggttttttggaagttaattgtattttttcgtgggtcgtatttgtggtttgagtagatgttcgatattgagttatagcgtcgtatgggaagcgggtgagttaaaaggtttgtaggatgacgtaggttcgtgattgagttatattgtaagttttgttttaggtagcgtttattcgtaaagtttaggttgtaggagtgttttagtgagttgaggtttatagtcgagtttcgtttaggattttggaagagttgttcgattttttgggtatggtagttgaggttagttttagttaaattggtgttagatatggaggagtatagtttattaggtaggttttgtgggtagggtttttgttttttatggggtttaggttttattattttttgtgttcggtaggttgggggtttaggaggtttagggtttcggggattatagaaggggttgttgttttggttaggtggggtagtatttgttatgttttttttaggtatattgggggtcgggtggaaggtgttagtgtagttgttgttaaaggggagtttgtagattatgttatagtatgttagttggtttttaggttttatttcggtaaggtttagggtattcgtaggtttttttgggagtagtgtggttatagtgtttgttgtgtttttttttatttgtattattattgtgtgtggttttttggtatttggtagagtatgtgatcgtagttttgtaggggtggttcggtggggttcggtatttggttttggtattgggtttggtttgaggttaatgttttgggcggtgtttatttgagtgattaaaacgttttttttggttagaggagttatttggttgggtaggttatatttggta

SEQ ID NO: 78 - DNA, 2380 bp, Artificial Sequence
  chemically treated genomic DNA (Homo sapiens)
gtttttgattatataattgtgttagaagttaatgattaaaagttaatttaaaattattatttgtttggaaatttaaagtgtttttataagatataaatataagaaagaatttaaaatgaaataagattgttttttaatttaatgatgagattataatatggtaataaaatgtttttttttggtttgggaatttttttttgtggtataaggttgtgtgattttaaattatttttaatttatttagatattttaatattcgaaatcgagtgatgatgtttttatttatattattttattgttcgtgtgtgtggattttaaattttgaatttaaatgagggggagaaaattaagttgatttttatgattggttttttagggacgtttaaggaatttatgtattttaagaaataaagtttattagttttttttttaaggtgtttgtttataatatttagagggtttggtcgtattatgtgtgatgggtggggagttttaagtaggtgggtaggatttaggggtttggtgattaggatagatttttattgtttattattttttttggttttgtttttagttaaattttttataggttttttgtttaattatatagagtgtgtttaaatttttttaggtttttggtagttgaaaattattgttttaaatttttttattatttattatgatataaggttattgtaaataggaaatattttattgatgttataaatagaaagttaatgtttttattataaatagaaaaataattttaagaaataagtaaaataaaaataaaataggggttgggggtggtggtttacgtttgtaattttagtattttgggaggtcgaggtgggcggattataaggttaggagttttagattagtttggttaatatggtgaaattttgtgtttaataaaatataaaaattagtcgggtgcggtggtgggcgtttgtagttttatttatttgggaggttgaggtaggagaatagtttgaattcgggaggtagagtttgtagtgagtcgagattgtattattgtattttagtttaggcgatagagcgagattttgttttaaaaatagtaataattataaataaaaaatagggttaataaaagtatggaatttaattttttttatatgttgtagttatgttttagttttagatttggttgggtatggtggtttacgtttgtaattttagtattttgggaggttgaggtaggcggattacgaggttaggagttcgagattagttttattaatatgttgaaatttcgtttttattaaaaatataaaaattagttaggtatggtggtatacgtttgtaattttagttatttaggaggttgaggtaggataattttttgaattcgggaggcggaggttgtagtgagtcgagatcgtattattgtattttagtttgggtgatagaatggaatgagattttgttttaaaaaaaaaaaaaaaaaaaaaaaaaaaagaagttttagatttcggttgtgttggttgtaaaaggagagatttagtaagtgggggttgtgtcgtagattgttatttataatggacgggttattgagtaggttcggttaattgggcgttttttcgttggagggttagtatattagattgtaggtggcgcgggttagtaaggtattaggggatgtgttatatatatagtttattttcgtttagttacgtacggatattttgggttttcgagtaaatttgtttttacgtggtgtgattatatggagttatagatatttagtaaggatacgtagttcgtatattttcggtattttagatatagtgatttgtattagggttcgaggtttttttaggggaatttattttttagaattatttagaaataagttattttttatttgtttagtaaaggtttgttgagaggtgtatagtgtttggagtttaagttgcgttaaggcggtaggatttttagtttagtttaggatttttagtagagtttttattttagcgtggaggtttgagaacgtgaggaaggagttgtttagtacggacgagtttaggtagttgtcgatgtttagtatttgttgttcggtaggtgtggggttcgggtttttagttatttgtaggacgatagtagtggttagcgggcggtagtttagatttgtttaggatttggatgagaagttatttttttagtagataggatagagttcggtgttatttgatagaatgttttagaatgttggatatatgggatatttgtatcgttcgtgatggtagtttttcgcgacgtgtgttattgaatatttgatagtagattggtgtagttaaggaatagagtttttaattttattttttttttttttagatggagtttcgttttgtta

SEQ ID NO: 79 - DNA, 2380 bp, Artificial Sequence
  chemically treated genomic DNA (Homo sapiens)
tgatagagcgagattttatttaagaaaaaaaaaaatgaaattgaaaattttgttttttagttgtattagtttgttgttaagtgtttagtggtatacgtcgcgaggggttgttattacggacggtgtagatgttttatatatttagtattttaggatattttgttagatggtatcgggttttgttttgtttgttgaggaggtggttttttatttaggttttgagtaggtttgagttgtcgttcgttgattattgttgtcgttttgtaggtggttgggagttcgagttttatatttgtcgggtagtaggtgttggatatcgatagttgtttggattcgttcgtgttggatagttttttttttacgtttttaggtttttacgttgaggtgagggttttattgggggttttgggttgggttgggggttttgtcgttttggcgtagtttggattttagatattgtgtattttttagtaggtttttgttggataggtgaagagtgatttgtttttggatgattttaagaggtgggtttttttagagaaatttcgagttttggtgtaggttattgtgtttggagtatcgggggtgtgcgggttgcgtgtttttgttgggtgtttgtggttttatgtggttatattacgtgggagtaggtttgttcggaagtttagggtgttcgtgcgtgattggacgggggtgggttgtgtgtgtgatatattttttggtattttgttgattcgcgttatttgtagtttggtgtgttggttttttagcgagggaacgtttagttggtcggatttgtttagtgattcgtttattgtgggtagtaatttgcggtataatttttatttattgggtttttttttttataattaatataatcgaaatttagggttttttttttttttttttttttttttttttttgagatagagttttattttattttgttatttaggttggagtgtaatggtacgatttcggtttattgtaattttcgtttttcgggtttaagggattgttttgttttagttttttgagtagttggggttataggcgtgtgttattatgtttggttaatttttgtatttttggtagagacggggttttagtatgttggtgaggttggtttcgaatttttaatttcgtgattcgtttgttttagttttttaaagtgttgggattataggcgtgagttattatgtttagttaaatttagggttggaatatggttgtagtatataaaaagaattgaattttatatttttgttaattttgttttttgtttgtagttgttgttgtttttgagatagagtttcgttttgtcgtttaggttggagtgtagtggtgtaatttcggtttattgtagattttgtttttcgggtttaaattgtttttttgttttagttttttaagtaggtgggattataggcgtttattatcgtattcggttaatttttgtattttattagatatagggttttattatattggttaggttggtttggaatttttgattttgtgattcgtttatttcggttttttaaagtgttgggattataggcgtgagttattatttttagtttttgttttgtttttgttttgtttgttttttagggttgtttttttatttatggtaaaggtattggttttttatttgtagtattaatagaatattttttgtttataataattttatgttatagtaaatggtaaagggatttaaagtagtggtttttagttgttagaggtttgagagagtttgggtatattttgtgtgattgggtagaaggtttgtgggaagtttagttgaggatagggttaggaaaggtgatggatagtgggggtttgttttggttattaggtttttgggttttgtttatttgtttggagttttttatttattatatatgatgcggttaagttttttgggtattgtgggtaaatattttaggagagaagttgatgaattttgttttttgaaatgtatagattttttggacgtttttgagaggttagttatgaaagttagtttggtttttttttttttatttgggtttagaatttaaagtttatatatacgggtagtaagatgatatagataaggatattattattcggtttcggatgttaaaatgtttaggtgggttaggggtgatttgagattatataattttgtgttataaagaggaatttttaggttagagggagatattttattgttatgttatgattttattattgagttgaaaggtaattttgttttattttggatttttttttatgtttatgttttataagggtattttgaatttttaagtaaataataattttgaattagtttttaattattgatttttagtatagttatatgattagaaat

SEQ ID NO: 80 - DNA, 2308 bp, Artificial Sequence
  chemically treated genomic DNA (Homo sapiens)
ttaggtaggaggtagttagttggtgatagcgcgcgtgattatagatttttgatttttatagttttagtagttgtttgtaggttttttacgggatcgtagtttgggagggtaggaggttttgtatttgcggtcggtttgatttgttttttatttttttgtttgtttttttcgtgttgggcgtcgtcgcgatacgtttcgcggatatttaggagtttttttagtttttgcgagcgcggattcgggagagagtttttatttaacgttgaggttattggtttatagattttttcgggttattttgcgaagtgtttggttttttttatttttagttttgtagtagtaataaacgggaaggaagtgggtgacgaggataggtagagattttttttacggggtcgttcgtattttatttgtcgtcgcggggcgggcgttgcggtcggtgtttagttgtagattcgtaggcgatcgtatttttggcggttttagttttaagtaggtagcggtcgattcgttttgttcgagggtttagggttgatttaggtgagtttcggcggggagggcgggcgtttcggttttttcgtttcggaattttgtatcgtttagagtcgttacgtttttcggttgtaggtttcgtatttgtaaaatgggtcgatgaattttaagggtcggtttagatttacggattgtagttgtagttgggttagaaggggtggttaggggagtcgattttattttttttttttttttacgttaattaggagtttttatttgtttgggattttttgggggtatttatgggtttatagtcgtagaattatagtattgggtggggttttagttttggggttaagtttttgtgaggtttgttattatttttttttgttgttttgtttttttgtttgtttgtttgtttggtttttttttttttgagatagagtttcgtttttttatttaggtcggattgtagtggcgcgatttcggtttattgtaagttttgtttttcgggttttcgttatttttttgttttagtattttcgagtagttgggattacgggcgtcgttatcgcgttcggttaattttttgtattttttagtagagacggggttttatcgtgttagttaggatggtttcgattttttgatttcgtgatttatttattttggttttttaaagtgttgggattataggcgtgagttatcgcgttcggtttgtttttgttttttttttttttgagatagttttattttggttgtttaggttggagtgtagtggcgtaattttggtttacgtaattttcgtttttcgggtataagcgatttttttgttttagtttttttagtagttgtgattataggtacgtattattacgttcggttaattttgtatttttagtagagacggggtttttttatgttggttaggttggtttttaatgttcgattttaggtgatttgtttattttagttttttaaagttttgcgattataggcgtgagttattatgtttggttagttttttgtttttttaaaaatttattatttagtcggtgtggtgttttatatttgtaattttggtattttgggaggtcgaggtgagcggattatttgaggttaggtgttttagattagtttgggtaatatggtaaaattttgtttttattaaaaagataaaaattagttggaggtgtttttttgaatttaggaggtagaggttgtagtgaattgagattatgttattgtattttaatttaggaggaggaggttgtattgagttaatattatgttattatattttagtttgggcgatagagtaagattttgttttttttaaaaaaaaaatagaaaaaaaaaaaaagaaagaaatttgaagtaattatgattaaatgttaatatttgtttttttacgtggtgggtataggcgtgttttggaagtttttatgttttttgtattttgagattatataaaattatgtttattattttattgtgttatatgatttttgtagaaaagttggtaaattttggaatgtacgaagaaaaagattataatagttagtaatatttttgtttagagagatagtatttattaatttttttttgtttatgtttgttttcggaaaaatgggatattattggtattattttataattttttaatttgtattaatattttttatattttttaaattgaaaaagttggttaagtatggtggtttaggtttgtaaatttagttaatgtgggaggatcgtttgagttcgggagtttaggaatagtttgggtatcgtggcgagattatattgttataaa

SEQ ID NO: 81 - DNA, 2308 bp, Artificial Sequence
  chemically treated genomic DNA (Homo sapiens)
tttgtagtaatgtggtttcgttacgatgtttaggttgtttttgaattttcgggtttaagcgatttttttatattggttgggtttataggtttgagttattatgtttggttagtttttttaatttaaaaaatatagaaagtgttaatataaattaaaaagttataaaatagtgttaatagtattttattttttcgaagataaatataggtagagaaaaattaatggatattgtttttttgggtaggggtattattggttattataattttttttttcgtgtattttagaatttattaatttttttataaagattatgtagtataataagataataaatataattttgtgtgattttaaaatataggaagtatagaagtttttaaaatacgtttgtatttattacgtgaagaaatagatgttaatatttggttataattgttttagatttttttttttttttttttttttgttttttttttgggggggatagagttttgttttgtcgtttaggttggaatgtagtggtatgatattggtttagtgtaattttttttttttgggttggagtgtagtggtatgattttagtttattgtaatttttgttttttgggtttaagagagtatttttagttaatttttgtttttttagtagagataaggttttgttatgttgtttaggttggtttggaatatttgattttaagtgattcgtttatttcggttttttaaagtgttaggattataggtgtgagatattatatcggttaaataataagtttttaaaaaaataggagattggttaggtatggtgatttacgtttgtaatcgtagaattttgggaggttgaggtgggtagattatttgagatcgggtattggagattagtttggttaatatggagaaatttcgtttttattaaaaatataaaattagtcgggcgtggtggtgcgtgtttgtaattatagttattagggaggttgaggtaggagaatcgtttgtattcgggaggcggaggttgcgtgagttaagattgcgttattgtattttagtttgggtaattagaataaaattgttttaaaaaaaaaaaaaataaaaataggtcgggcgcggtggtttacgtttgtaattttagtattttggaaggttaaggtgggtggattacgaggttaggagatcgaaattattttggttaatacggtgaaatttcgtttttattaaaaaatataaaaaattagtcgggcgcggtggcggcgttcgtagttttagttattcgggggtgttgaggtaggagaatggcgagaattcgggaggtagagtttgtagtgagtcgagatcgcgttattgtagttcggtttgggtgaaagagcgagattttgttttaaaaaaaaaaaaattaaataaataaataaataaaaaaataaaataataggagaagatgatgatagattttataagagtttggttttagggttgaaattttatttagtgttgtggttttgcggttgtgggtttatgggtgtttttaaagggttttaggtagatggaggtttttggttggcgtggaggaaggaaaaggatgaaatcggtttttttggttattttttttagtttagttgtagttgtagttcgtgggtttgagtcgatttttggggtttatcggtttattttatagatgcggagtttatagtcgggaggcgtggcggttttgggcggtgtagggtttcggggcggggaggtcgaggcgttcgtttttttcgtcggggtttatttgggttagttttgagttttcgagtagggcggatcggtcgttgtttgtttaaagttggggtcgttaggagtgcgatcgtttgcggatttgtagttgggtatcggtcgtaacgttcgtttcgcgacggtaggtgagatgcgggcggtttcgtgggaggggtttttgtttgttttcgttatttatttttttttcgtttgttgttgttgtagggttgggaatgggggggattaagtatttcgtagggtgattcggggagatttgtgagttagtggttttagcgttgaatgagagttttttttcgggttcgcgttcgtagggattgaagggatttttgaatgttcgcgggacgtgtcgcggcggcgtttagtacggaggaggtaggtagggaggtgaggagtaggttagatcggtcgtaggtgtagggttttttgtttttttaggttgcggtttcgtggagggtttgtagatagttgttgagattatgagggttagaggtttgtggttacgcgcgttattattagttagttgttttttgtttgg

SEQ ID NO: 82 - DNA, 2352 bp, Artificial Sequence
  chemically treated genomic DNA (Homo sapiens)
aggcgatttttggatttattttttttttattattgtttttggatttgaggttcgtagtgttttggtagggttagtaatgacgttgacgttgggagagatgtgattagagggtggagatatgttcgtttattattattttcgtaggttaattttggttagaggtggttatttttggtttttataggttggaggttttatgtatttttgttagttaggtttcggggttaggggatacgagagtttttatatttggtagggtgggtcgttttttagagagggagtacggagtttgttttattcgtcgtggcgggttttagggtttattgagaggcgtcggttagcgtaagaggatattttatagttatgtaattcgggttagcgaggatgggttcgtagttcggttagttaaaataagtatcgttcggttttagagtgtgaaattgttaggtttaattaaagggagtttagggagtcggttgggggttggataggggaagagtttttttgggaagggttgtaggttgtgaggtttgatttattttgtggaggtttggttttgttgttattcgggtattttggggaggacggggggaggcgttcggagtttttttttttttcgtttagttagattgggatattttatatataaatacggtgtaagatggagggatagttagagatatttttgttttttttttttgtttagggagttttggaggtcggttttcggtgagatatgggttttttgagtagttaggttttggtgggttttgagattttgataggagtttaggtttggttgttatcgggaatttatagtgtaggggtaggagttagcgtcgattttagggtaggaaggggtattttattatttggtgtagggtttggggtggagcgaatgttttttaaatgttgaggaaaaggaggattatgtgggttgtgttgggttgttttgggggtgtttttaaggttttggggtgattcgatgttgggtatggttcgggggaagggagatatattaacgaggtacgttattttggcgtggtatttcgtgtttgtagagggtataatttttttttttgtcggttatttttagggttagttaaatgtagtaagaggtattattagttttaagaggaggtgaggggaatacgttttatttcgtgtattttaggttggggttttacgagtaggatatggttggtttggagtcggtttcggacgaggttgattttttatagtagtgaaggggtagtagttgggtaggaagtggagtttggtggagattattaggggagcgaggggttgtgcggttgagtagggggcgtattttttattttatggagttcgggagatggtttttataaagtttatttttagatataggaatgagaaaagtaaaattgaggttggaggaaggtttggaggtattggttgtgtttgtagtggagggaggggtttagtaagaaagtttgggttacgcgggaggtattttcgggtcgggagtggcgggagttgcgagttttttatggttttgtcgcgtgtgtaaggcgtggggagtgggtgagtttgcgcgttattttggttgggttatttttatttaattttattagatgttgtggtgaagatgtgtttagatgtgggtatatttgatattcgcgggttttgagttacgtaggtgggttttttatcgtgtgaggggttttatttaattaagggaaggtttttagaggaaaagattagttttttaaggagggggttttgtttttagatgtaaaatcgtagtattaattttttttagatttttagtttgttaaggttgttagcgttttttataattgttggttttttaaattattttttttcgtcgttttttatatatatatatagagtttagtatattttttattgattttgtttttttgaagaatttttgttaataggaggatagtgatgggaaatgtttatgacgttttacgtacgtttaatgtaatatgtgttttgtttaaaagattttttgttgttaagcgttttttatggtgtaggggtgttatatgagagtttaggagggttttggggtttgattggatagagttaggtaagggttcgttggtgttgggatggatatttatgttgtttatttaattagggtttttttggagaggaagattttatgtggggaatgttagtttcgttttgtagttgaggtttatatttttgtcgtgagtattttggacgtgttgttcggtttgttggttttggtaaaattttttttatttgtatataaagttttgagtgttttagtttttgtttttggatatgaaatatagggaaatgatatttagttaggga

SEQ ID NO: 83 - DNA, 2352 bp, Artificial Sequence
  chemically treated genomic DNA (Homo sapiens)
tttttggttgaatgttatttttttgtgttttatatttagggataggggttagagtatttagagttttgtgtgtaaatgggaggaattttgttaaagttagtaagtcgggtaatacgtttaaaatgtttacggtaaaaatgtgagttttaattgtagagcggagttggtattttttatatgaggtttttttttttaaggggattttgattggatgggtagtatgagtgtttattttaatattagcgagtttttgtttggttttgtttagttaggttttagggtttttttgggtttttatgtggtatttttgtattataggaagcgtttgatagtaaggggttttttgagtagagtatatgttgtattaaacgtgcgtggaacgttataaatattttttattattgtttttttgttggtaagggttttttagagaaatagaattaataggaagtgtgttagattttgtatgtgtgtgtgagaagcggcgggggggggtagtttaaggaattagtaattgtggggggcgttggtagttttgataggttggagatttaggaagagttgatgttgcggttttgtatttgagggtaggattttttttttggggagttggtttttttttttgaaggtttttttttgattggatgaggttttttatacgatgaggggtttatttgcgtgatttagagttcgcggatgttaggtgtgtttatatttaaatatatttttattataatatttggtgaagttgggtggaggtggtttagttaaggtgacgcgtaaatttatttattttttacgttttatatacgcgataaaattatgggaagttcgtagttttcgttattttcggttcggaaatgtttttcgcgtggtttaggtttttttgttgagtttttttttttattgtagatatagttaatgtttttaggtttttttttagttttagttttgttttttttatttttgtgtttggggatgggttttatgggaattatttttcgggttttatgagataagagatgcgttttttgtttagtcgtatagtttttcgtttttttagtggtttttattaggttttattttttgtttagttgttgtttttttattgttgtggagggttagtttcgttcgggatcggttttaggttagttatgttttgttcgtggggttttagtttggggtgtacgaagtggagcgtgttttttttatttttttttggggttggtggtgttttttgttgtatttggttggttttggagatggtcggtaggaaaaggggttgtgttttttatagatacggagtgttacgttagggtaacgtgtttcgttggtgtgttttttttttttcgggttatatttaatatcgagttattttaaagttttggaggtatttttagggtagtttagtatagtttatatggttttttttttttttaatatttagagggtattcgttttattttaggttttgtattaggtggtgggatgtttttttttattttggagtcgacgttggtttttatttttgtattgtgaattttcggtaatagttaagtttgggtttttgttagaattttaggatttattagggtttggttgtttagagagtttatgttttatcggggatcggtttttaagattttttaggtagaaaaagggagtaagagtgtttttggttgtttttttattttgtatcgtgtttgtgtgtgaaatgttttagtttaattgggcgaaagaggagaaggtttcggacgttttttttcgttttttttagggtgttcgggtggtagtagggttagatttttatagagtggattaagttttatagtttgtagttttttttaggaaggttttttttttgtttagtttttagtcggttttttgagttttttttaattgggtttgataattttatattttggagtcggacggtgtttgttttggttggtcgggttgcgggtttattttcgttggttcgggttgtataattgtgaggtatttttttacgttggtcgacgttttttagtgagttttgaagttcgttacggcgggtggagtaggtttcgtgttttttttttgggaggcggtttattttgttaggtgtgggggttttcgtgttttttgatttcgaggtttggttggtaaaagtgtatggagtttttagtttatgggagttaggaatggttatttttggttagagttggtttgcgagggtggtgatgggcgggtatgtttttattttttgattatattttttttagcgttagcgttattgttggttttgttagagtattgcgggttttaggtttagagataatggtggggagggggtgaatttaggagtcgttt

SEQ ID NO: 84 - DNA, 2229 bp, Artificial Sequence
  chemically treated genomic DNA (Homo sapiens)
gaataggtttatatttatttttcgttttttttttttattaatttgggagagggaagagtagagattatggttttaaagttttcgagtatttggttgaagtttagtgttgggcgttatgtgagttggaggaagttagggtgggtggagtttaggttggtttgattgtgaggtttgttagtgtttgttagtggggcgaaggtttagagatgttaggcgttttaagggtttacggcgagaattggttgttagtcgttgttgtgttaggaatgattgggtatgggtaggcgttcgtttttttttagttcgttgttgtaaggttatgttttttaggaggaggtgtggttggggttaggtgagtttataggatttttttattaatattttatttatgagattttagagtttagattttatatttattatattatattaggtattgatgagtagtttttttttttgttttcgttgatttcggttttttttaaagtttatttgttaaggaggtaagtgttaggggtttagatacgttggaggtagcgtaaagggacgaggatatttatttttaggtgtcggatgcggatatttcgttttcggagttgtgtttttagggaatggagttttggaggtgttttcgtagttggtcgttgtttgggttttatggtttgtatgatttataggttgaggaagttatagttaggtgattttggttttgaaattttttgggatatattggggtgtgtgtatttatttatttttttatttattatagagatagagtttttttatgttgtttaggatggttttgaatttttggtattaagtaatttttttgttttagttttttaaagtgttgaggttataagtatgagttattgtgtttatttagttagtattttatttttattttatttttatttttatttttgtgatggagtttggttttgttgtttagtttggagtgaagtggcgtatttttagtttattgtaatttttgtttttcgggtttaagtgatttttttgttttagtttttcgagtagttgggattataggcgtatgttattaatttcgtttaatttttttatttttcgtagagacggggtttcgttatgttggttaggttgttttcgaatttttgattttaagggattagttgttttagttttttaaagtgttgggattagcggcgtgagttattgcgtttggttgtgcgtaattttttttttttttttttttttttttgagatggatttttgttttgtcgtttaggttggagcgtagtggtataattttagttaattgtaattttcgtttttcgggtttaaatgatttttttgttttagttttttgagtagttgggattataggtatttattattatgtttagttaatttttgtatttttagtagagatggggttttattatgttggttaggttggttttaaatttttgattttatgtttcgtttgttttgattttttaaagtgttgggattatagttatgagttacggtatttagttagttgtgtagtattttaatgtgataattagtagtagtggggaattatgtagaagtttgttttatggtggggtatgataggtatgagttgggggtatagatgtgtaagtaggaggtttgatttaataggaggtataaaaagtaagaagttagggtaggtaatttgtgggaatatttagcgtttttattatgcgggttttgtttacgtagcggcggtatcgtttttttatggttcgtaagttcgcgttttttttttgtaagttatgttgtagtttttcgattcgtcgggttgttggcggaagaggtggtttattagttttacgttgttgggttttgggatttttttattttttggttattaggttttatttattgttgttgttagtgggtggttttagttttttaatgtattttcgttttttttgtaattttagatttgttttatgaagtttttgtttgtgggtcggggatgagtagtagtgggttgattttcgggttggttttttttttgttttagtggtagttatagattttttcgttagttagaaatgtttttatatggttatagagttttttttgtttgttttttatgtttggggttgtgtgttttggttttatcggttttatagttgttagagttataatttttcgtatttttagtaggtatgtttcggaatagtttttgttgtttatttttttttattttatagt

SEQ ID NO: 85 - DNA, 2229 bp, Artificial Sequence
  chemically treated genomic DNA (Homo sapiens)
gttgtgggatgggaagaagtggatagtaggggttgtttcggggtatatttgttaagggtgcggagggttgtggttttgatagttgtggagtcggtgggattagggtatatagttttaggtatgaggggtaggtagagagggttttgtggttatgtaggggtatttttggttggcggggaggtttgtggttattattgggataaaagagaagttagttcggaggttagtttattgttgtttattttcggtttataggtagaagttttatgaggtagatttggagttgtagaggaagcgggagtatattgaggagttggagttatttattgatagtagtagtaagtaggatttagtgattagagggtggggagattttagagtttagtagcgtggagttgatgggttatttttttcgttagtagttcggcggatcgaggagttgtagtataatttgtagaagaaggacgcggatttgcgggttatggaggagcgatatcgtcgttacgtggataaggttcgtatggtgaggacgttgggtgtttttataagttgtttgttttggttttttattttttgtgttttttattgagttaaattttttgtttgtatatttgtgtttttaatttatatttgttatattttattataagatagatttttgtatgattttttattgttattgattgttatattaaaatattgtatagttggttgggtgtcgtggtttatggttgtaattttagtattttgggaggttaaggtaggcggaatatgaggttaggagtttgagattagtttggttaatatggtgaaattttatttttattaaaaatataaaaattagttgggtatggtggtgggtgtttgtaattttagttatttaggaggttgaggtaggaaaattatttgaattcgggaggcggaggttgtagttagttgagattgtgttattgcgttttagtttaggcgatagggtaagagtttattttaaaaaaaaaaaaaaaaaaaaaaaaaattacgtatagttaggcgtagtggtttacgtcgttaattttagtattttgggaggttgaagtagttgattttttgaggttaggagttcgagagtagtttggttaatatggcgaaatttcgtttttacgaaaaatagaaaaattaggcgggattggtaatatgcgtttgtaattttagttattcgggaggttgaggtaggagaattatttgaattcgggaggtaaaagttgtagtgagttgagagtgcgttattttattttaggttgggtaatagagttagattttattataaaaataaaaataaaaataaagtaaaaataaagtattggttggatgggtataatggtttatgtttgtaattttaatattttgggaggttaaggtaggagaattgtttgatgttaggagtttaagattattttgggtaatatagggggattttgtttttataatgaatgaaagaatgaatgaatatatatattttagtatgttttagggggttttaaggttaaagttatttggttatgatttttttaatttgtaggttatgtagattatggaatttaagtagcggttagttgcgggggtatttttagaattttattttttgaggatatagtttcgagaacgggatgttcgtattcgatatttggaggtgggtgttttcgtttttttacgttgtttttaacgtatttaggtttttgatatttgtttttttgatagatggattttgagaaaagtcgaagttagcgggagtaggaagaaaagttgtttattagtgtttggtataatatggtaagtgtggggtttgggttttaagattttatgggtagaatattggtgggggggttttgtgagtttatttgattttaattatatttttttttgaagggtatggttttgtagtagcgagttggggaggagcgggcgtttgtttatgtttagttatttttggtatagtagcggttggtaattaattttcgtcgtggatttttgggacgtttggtatttttgaattttcgttttattgataagtattgatagattttataattaagttagtttgggttttatttattttggttttttttagtttatatggcgtttagtattgggttttagttaggtgttcgagagttttgaggttatgatttttgttttttttttttttagattggtggggagggagggcgggaggtagatataggtttgttt

SEQ ID NO: 86 - DNA, 2280 bp, Artificial Sequence
  chemically treated genomic DNA (Homo sapiens)
ttgttttggttttatgtttgtaaggttttcggtttaagaggtttatcgattttttttgtttttttttagttgattataaaataaataaataaataaataaataaataaataaataaataaaaaagtaggatattaaatttgttatttttagagggttttttagtttttttttttatttttgaattgagcgaagcggtgtcgatttttattttttgggtacgagtttttgcgtatttgggagatttttgaatattttcggagaagttagaaagtttcgggagatggtttcgtttgttgttgtattagatcgggttttgtaaaggatgtatttttcgagttttttttttgtacgtttagtggggtttgtttcgattttatttgagggatttattggaggagaggtacggggatgttgtttgagtagcggatttttttggcgcggagtaggttgtttttaggtagagttcgacgggtttttttttttgggtgttttcggtttttcggattttagtaggtttgggaaggtttcgggtttttttagtcgatgtttagagagtttttattttttaagttttgttatcgaatttatcggtcggtgcgtttttgatcgtagggtaagggtttgcgtatttttaaagataagcggggttttcggaaggtttttaggtagaaatgagtattacggggaacggttcgtttttaagataatttcggggatatggatataataagatagggtggtaagttttaataaggcgggtgcgcggcgtttgagggtggtcgggtcgggtcgggtttggttttgcgtttatttcgttaagaatcgtttgggtacgggtttcgcgggatgtttcgcggtttatttttttttttaggacgtaaggaggaacgtttcggcgcgcggttagtagcggcgggtatcggtttaatggttacggaatttagtattggtagtcggttttttttatatcgtaggcgtgtagtgtggtcgacggagtttttcgggtcgaggatttagttaggtcgttatttcggttgtttttacgggaaggggtattaggtaaattgtttaaggtttcgagtttaggttttttggcggaggttttcgttggtttcgtttagattatggtcgttattaggttttcgagttatggttttttgttcgggaacggttcggcgttttggttgtttagttagttttggcgtttttttttggggtttttatcgttcgatttcgcggcggagtttgtttttttcggatttttagagatttcggattcgttcgagtatttgttttagttttgtttggttttttaggatagttttaagttatttttttttaggcgagtatagcgaagggtgcgcgggattgttaagttagttttttttgatggtagtattgttttagaaatgtttatttgttttttttttacgtttatttttttcgttttttgttgaggaaaaaacgttaatagcgtttcgtatatggcggattagtatttcggtcgttttgggttagttttggtttatttgcgggattttgtttttggtagatgggattcggcgggattttttttattagtttgtttttttgataaattagaaagcggtttttttggatcgttttggggatggattcgatttaatcgtatttttaacgatgcgttaggatgggaggatggtggaattcgtagggacgagaaggagattgggtatatattaggattttagtttcggttttgtttttcgggatatattggtatttgggtatttttacgggttacggtaaggttagtttgattaagaggttaaaggcgattggcgttttattgatcgttgggggtttggttttaaattttaggtgaatttataatttcggaatagcgggatcggtattcgggttttttttacgtggtagtatcggtaaggggttgggggaagagtttacgttagtttacgttacgtaggaagggagttagtggttattttaaatatattttttttttttatatttggtttacgtttaattttttacggttttgtttagaaggttgtacgtataatatatatagaggcgggtatttttttgacgattcgtgtgtgtcgtgggggagcggtagatggtttagttttaagtgtttcgatttttttgtttaaatatattttgtgacggaaagtttatgttgatttcgttcggtatttaaggcgtgggtagcggtttaacgtttgttgcgggaatatagtcgcgttgaatgttatttttaagatagataaaatagt

SEQ ID NO: 87 - DNA, 2280 bp, Artificial Sequence
  chemically treated genomic DNA (Homo sapiens)
attgttttgtttgttttgagaatagtatttaacgcgattgtgttttcgtagtagacgttaggtcgttgtttacgttttgagtgtcggacgaggttaatataggtttttcgttatagaatatgtttgggtaggaagatcggaatatttggggttgggttatttatcgtttttttacggtatatacgagtcgttagggaaatgttcgtttttgtgtgtgttgtacgtgtagttttttgggtagagtcgtggagagttggacgtaggttaggtgtgaggaggagaggtgtgtttggggtggttattggttttttttttgcgtgacgtaggttggcgtgggttttttttttagttttttgtcggtgttgttacgtgagaagggttcgggtgtcggtttcgttatttcggaattgtgggtttatttgaagtttgaggttaaatttttagcggttagtgggacgttagtcgtttttgattttttggttaagttggttttgtcgtgattcgtgagaatgtttaagtgttaatgtgtttcggggggtagggtcggggttgggattttagtgtgtgtttagtttttttttcgtttttgcgggttttattatttttttattttaacgtatcgttagggatgcggttaggtcgggtttatttttagggcggtttaaggggatcgttttttggtttgttaggaaggtaggttagtaagaagggtttcgtcgagttttatttgttaaggatagggtttcgtaggtgggttagggttggtttaaagcggtcgagatgttgattcgttatgtgcggggcgttgttggcgttttttttttagtaaagggcggagggagtggacgtgggggaagggtaggtgggtatttttggagtaatattgttattaagaggaattggtttggtaatttcgcgtatttttcgttgtgttcgtttggggaggagtggtttgggattgttttgggggattaggtaggattagggtaggtgttcggacggattcgaggtttttggaggttcgagagaagtaggtttcgtcgcggggtcgggcggtggaagttttagagagaggcgttaggattagttggatagttaggacgtcgggtcgttttcggataggaagttatggttcgggagtttggtggcggttatgatttgggcgggattagcggaggttttcgttagggagtttgggttcggggttttgggtagtttgtttggtgttttttttcgtgggagtaatcggggtgacggtttagttgggttttcggttcgggaggtttcgtcggttatattgtacgtttgcggtgtgaggagggtcgattgttagtgttgagtttcgtggttattgggtcggtgttcgtcgttgttggtcgcgcgtcggggcgtttttttttgcgttttagggaggaaggtgggtcgcggggtatttcgcggggttcgtatttagacggtttttgacgaggtggacgtaaggttaggttcggttcggttcggttatttttagacgtcgcgtattcgttttgttgagatttgttattttgttttgttgtgtttatgttttcgaggttgttttggaggcgggtcgtttttcgtggtgtttatttttgtttgggggtttttcggggatttcgtttgtttttgggggtgcgtaggtttttgttttgcgattagaggcgtatcgatcgatgagttcggtggtaaagtttgagaaatggagattttttgggtatcggttaagggggttcggggtttttttaggtttgttggagttcgggaagtcgggggtatttagaaggaaggattcgtcggattttgtttggggatagtttgtttcgcgttagaagggttcgttgtttaggtagtattttcgtgttttttttttagtgggttttttaggtagaatcggggtaggttttattggacgtgtagggaggaggttcggaggatgtattttttgtaggattcggtttggtatagtagtagacggagttatttttcggggttttttggttttttcgagggtgtttaggagttttttaagtgcgtaggggttcgtgtttaaagggtggaggtcggtatcgtttcgtttaatttaggagtggagaaggaagttagaggattttttggaggtggtaggtttaatgttttgtttttttatttatttatttatttatttatttatttatttatttattttgtaattaattgaaagaaggtagaaggagtcgatgggttttttaggtcggaaattttataagtataggattaaggtag

SEQ ID NO: 88 - DNA, 2438 bp, Artificial Sequence
  chemically treated genomic DNA (Homo sapiens)
tgtcgtggaggtaaagcgaagtaatgtatataaagtagtgagtagacgtttggtatgtaattttagttaacgcgggttagttttgatagttggggttttgtacgtagggaaggtagggttataggtagaggggtgtgaggattttatttttattttttggtatttatataattttgattttgagtttaatttgtttatcgtgagtattagggtatgtaggggagtatagtggaggtggtagtttagggaattttgtaggtgtagggtgagggtttttagagaattttagtattcggtattaggttagattttattagaagaggtcgggcgtagtggtttacgtttgtgattttagtattttggaatgtcgaggttggtggattatttgaggttaggagttcgagattagtttggttaatatggtgaaattttgtttttacgaaaaatataaaaattagtcgggcgtggtggtgtatgtttatagttttagttatttaggaggttgaggtaggagaatcgtttgaatttaggaggtagaggttgtagtgagttgagatcgtattattgtattttagtttggaggatagagcgaggttttattttaaattaaaataaaataaaaaaattttataggaagaaatggtattattattttattggttttgttagtattttttggaaatggttttaaagggtttttaaggtttagggcggtgtgggttagtgggaggttattttgttttgtaggaataagggagagacggtattagttagttttttattatttttcgggaagatatgacgaaaatcgattggatggtagatttttttacgaaatttttattaggcggttagggttttggtgggtatacgaatacgtatatagatatacgtattttcgtataaggttttcgaggttacgggttttttggttagcgttggtttgttcgaggtatatacgttggggttagtgggggacgtgggtttggtttttgtttcgggggggttttttgtggttagtgtaggttcgagggtgggaatgggtttttttagtttggcgtgtagtttgaagatttgtaatagatagagtcgggttttcgcgtgagggtcgtttttagtttgatggttttttttaagaggtaggaagggtttttacgggcgtgtagcgcgagtgtgggttggtcggttttagggattttttttttttttttttttttgttttttggataatatttattttagaaggttttttttaggtggttttttgttttgtatacgtgtttgtgatttttttagtacggtgatatttttttagtgtgtgagtacgtggtttatcggtttatacggacgttttttttttttttttattacgtgggttgttaggtggggtcgttttttagttttttaagttttagtttagtgttttttgattgttcgggatttagtatgtgtggatggatggtgggtgtgtacgtgtttttggacggatatttacgttttgtacgtacgtgtgtatatggttacgttcgtattttggtcgtgttttatttttagtatttttaggtataaggtgtttttggtaaaggtttcgtgtgtatagggttattgtgtgtgtgttggggattattttagatatattttttagttttgtttttgatacgttgtattttggtataagatttgttttgtattttttaattttataacgggtagtagggtttgtttgatttttagattgagttttagtttgtgggggtgatatttgtagttttgttttatcggtttttagtttttcggtttttaggttaagtttttttttttcgtttttttgtttcgtttttttttttttttatgtttttttgtttattttttttttttttgtgggtttatacgggtttttagtaagttgttttgagtcgagttagggaatgaggttttggatgagtttttaggtagttgggggagagaagttaggtttttagttaggttttttagggtggtttagtttgatagttcgggttatagtataagttagttgttttttttttgtttttaggtggggattttatttttttttcgtcgaatatgacgaaatttaggtttttttttttttttttttggcgatagagttttgttttgtcgtttaggttggagtgcggtggcgagattttagtttattgtaatttttatttatcgggtttaagtaatttttttgttttagttttttgagtagttgagattataggtacgtatttattacgttcggttaatttttgtattttttagtagagacggggttttattatgttggttaggttggttttaggtttttaattttatgcgatttattcgtttcggttttttaaagtgtcgggattataggcgtgaggtattacgttcggtttgatttagattttattaaggttttaggagaatag

SEQ ID NO: 89 - DNA, 2438 bp, Artificial Sequence
  chemically treated genomic DNA (Homo sapiens)
ttgtttttttgaggttttagtaaggtttgggttaggtcgggcgtggtgttttacgtttgtaatttcggtattttgggaggtcgaggcgagtggatcgtatgaggttgggagtttgagattagtttggttaatatggtgaaatttcgtttttattgaaaaatataaaaattagtcgggcgtggtgggtgcgtgtttgtaattttagttatttaggaggttaaggtaggagaattgtttgaattcggtaggtggaggttgtagtgagttgagatttcgttatcgtattttagtttgggcgatagagtaaggttttgtcgttaaaagaaaaaaaaaagaggtttgggtttcgttatgttcggcggggaggggatggagtttttatttgagagtagggaggggatagttggtttgtgttgtagttcgggttgttaggttgagttattttgagaggtttggttgaggatttggttttttttttttagttgtttggaggtttatttagggttttattttttggttcggtttaggatagtttgttgagggttcgtgtgaatttataggggaaagaggaatgagtagggaggtatggaggagggaaggagcggggtagagaaacgggggaaggagatttggtttggggatcggagagttaggggtcggtggggtagagttgtaggtgttatttttataggttggggtttagtttgggggttaggtaggttttgttgttcgttgtggggttggggggtatagggtaggttttgtattagggtatagcgtgttagagatagagttgggaagtgtgtttgagatggtttttagtatatatatagtggttttgtgtatacggaatttttgttagaaatattttgtatttagaggtgttgagaatggggtacggttagaatacggacgtgattatgtgtatacgtgcgtgtagaacgtgggtgttcgtttagggatacgtgtatatttattatttatttatatatgttgagtttcgggtagttagggagtattaggttggggtttgggaggttgagaaacggttttatttggtagtttacgtggtggaggaggaggaagagcgttcgtgtgagtcggtgagttacgtgtttatatattagaggagtgttatcgtgttagagaagttataagtacgtgtgtaaggtaggaggttatttgggaagggttttttggagtgggtgttatttagagagtaggaggagagaagagaggggggtttttgggatcggttagtttatattcgcgttgtacgttcgtggaggttttttttgttttttgaaaaaggttattaggttgggagcggtttttacgcgggagttcggttttgtttgttgtaggtttttaagttgtacgttaaattggggaagtttatttttattttcgagtttgtattggttatagagagttttttcggggtagaggttaagtttacgttttttattggttttagcgtgtgtgtttcgagtaggttagcgttggttaagagattcgtggtttcgaaggttttatgcgagggtacgtgtgtttgtatgcgtgttcgtgtatttattagagttttggtcgtttagtgaaagtttcgtgagaaaatttattatttagtcgattttcgttatgttttttcggggggtggtgaggggttggttggtgtcgttttttttttatttttgtagagtaagatggttttttattggtttatatcgttttgaattttggagattttttgagattatttttagagagtgttggtagaattaataaaatggtaatgttatttttttttgtagagtttttttgttttgttttggtttgagatggagtttcgttttgttttttaggttggagtgtagtggtgcgattttagtttattgtaatttttgttttttgggtttaagcgatttttttgttttagttttttgagtagttgggattataggtatgtattattacgttcggttaatttttgtatttttcgtagagatagggttttattatgttggttaggttggtttcgaatttttgattttaagtgatttattagtttcggtattttaaagtgttgggattataggcgtaagttattgcgttcggttttttttggtagaatttggtttggtgtcgggtgttggggttttttggaagtttttattttgtatttatagggttttttgggttgttatttttattgtgtttttttgtatgttttggtgtttacggtgaataaattgggtttagaattagagttatatgggtattaggaaatgaaggtggaatttttatatttttttgtttgtgattttattttttttgcgtgtaaagttttagttgttagagttgattcgcgttaattaggattatatgttaggcgtttgtttattgttttgtgtgtattgtttcgttttatttttacgata

SEQ ID NO: 90 - DNA, 2403 bp, Artificial Sequence
  chemically treated genomic DNA (Homo sapiens)
agaaaagttaaatttagtttttgtttttgttttttttggttttatgatgtgtatttgttattttgaaattggaaattagtttattaatgtttgtgttaattttttattttttttttaatttttttttttatacgattttttatttatgtaggatgtgtgttgtttaatgatgggatgattatatttttttatgttttaaaagtgttttttttttatagggttttagggttggtggttgttttgggtttatagttacgttttattcgttttttgttttaatagtttgtgtggtggtaaagtcggtgtggggttggggaacgtagcgttttttaggaggggattcggttttttttttgtagtgtaggcgaaggtttagatgttagtgtgattttttataaggcgtggtttttagatttttcggtcggaagtgatgtttttttgtcgcgggttttgggtttgaagtagtttggtttttttttggtaagtggttggtgttttagtagttgtaatttgagtttagttatttatatattatcgtggtcgatatttttattaaaaagttttttgagacgatttgcgtgtatgttgattttatgattagcgtcgttgggaagaattttagagtcggtggggtggggttggaagtagtaggtgtagtgatagggttgggtgtttaggaggttttagtgtttaattaggttaaggtggttaagtttaggttgtagggaaggtcggtttggggggtgtgggtgagtataggtaggtattagttgggtagtgttaggatgttggagtagtattcgtaattttattgagtggggtagtttggttggggtagggatcgttgttgttttggtagagagagaggatttttattggggagaggttgttttgattttgtaggtgggatagggatagatggttattagggtgattcggttggtttttttttgttatgttaagttttgggatatggaggatttttgttatatagtttgggttcgggtttttatttgtggttatcgttttggtatgagttttttagttttgggtggtttttgtttggttcgggatttggtgttgttgttgagtttagtttttttgttattttcgtatgggtcgtgggtggtgatgttagttgttttttattttggttttagtagtttatttagtttataggggagttgttttgggttggagatgggtatgtattttgggttttatttgaatgaatgtagtttgaggagattcggttatatatattgggttataggttattttcggtaatgtttatattagtcgttagtttgagtttttttaggagagtaaggtttatacgataaaggttgttcgtggttagtgaggtggttgagtttagttaggatttttttcggattttcgggatgtggttttgttcgtgagttgtttggttagttttttcggggtgagaggggtttgttatacgggtttttgtttgtagtgtgattttttttagttttttttagtagttttgtttgtagagtgttattattattatgattatttttttgatattgcgagggtcgggggacgttttgggtagagatagggttcgtggtagtagtaggtttaggggcgttttatattggtgggttggggatttggtggagattacgttaagggttggataaggggacgagtttttattttggttttttcgtaggttttagtagttttttttataggtagaagggttgatattgggttttgtttttattgtaagagttgtaagtgttacgtgttgttttgtttaatttggtgtttgtaggtgaggaaaggattgtcgttggttcgtttttgagtgtttagtatttaagggtgatagtattgtttgtttttatttttcgggttttgtttgaagattaaatttatgtttataggataattttttttttttttagagatagggttttattttgttatttaagttggagtgtagtggtgcgattatagtttaatgtagtttttaattttcggatttaagggatttttttgttttagtttgttaagtagtttggattatagttgtgtgttttattattattttgtagatatggggtttggttatgttgtttaggttatttttaaaattttcggttttaagtaattttttcgttttagttttttaaaggttgggattataggtgtgaggtaaggtatttagtttagttatagagttttattgtattttttttattaggagtaagagttgattgtttttttatttttattttagagtgttggggttgtgttgagtcgaggtcgggttattggtatggtttagggagcgggattatttattgttgttttaaatttgagattattttattttgataagatttttttatttaatttttttatttg

SEQ ID NO: 91 - DNA, 2403 bp, Artificial Sequence
  chemically treated genomic DNA (Homo sapiens)
taagtaaagggattggatgaggaagttttgttaaggtggaatgattttagatttggggtagtagtgaatgatttcgttttttgagttatgttagtggttcggtttcggtttaatatagttttaatattttggaatggggatgagggggtagttagtttttgtttttagtaagagagatgtaatagggttttgtggttgagttgggtgttttgttttatatttgtaattttaatttttgagaggttgaggcgggaggattgtttgaggtcgggaattttgagaatagtttggataatatagttagattttatgtttataaaataataataaaatatatagttatagtttaagttatttggtaggttgaggtaggaaggttttttgagttcgggaattggaggttgtattgagttataatcgtattattgtattttagtttgggtgataaagtgagattttgtttttaaaagaaaaaaaaattgttttgtgagtatgggtttgatttttaaataggattcggagggtagggatagatagtgttgttatttttaggtgttgaatatttagaaacgggttagcggtagttttttttttatttgtagatattagattgggtagaatagtacgtggtatttgtagtttttgtagtgagggtagaatttagtgttaatttttttgtttgtgggaggggttgttgaggtttgcggagaggttagggtggaggttcgtttttttgtttagtttttggcgtggtttttattaggtttttagtttattagtgtagggcgtttttgagtttgttgttgttacgggttttgtttttatttaggacgtttttcgattttcgtagtgttagggaaatgattatggtggtggtgatattttgtaggtagggttgttgagagaagttgagaagggttatattgtaggtaggggttcgtgtgataagttttttttatttcgagagagttgattaggtagtttacgagtagagttatatttcgggagttcgagaaaggttttggttgggtttagttattttattggttacgggtagtttttgtcgtgtgagttttgtttttttggggaggtttaggttgacggttgatgtgggtattgtcgagggtaatttgtggtttagtgtatatggtcgggtttttttaagttgtatttatttaagtaggatttagggtgtatgtttatttttagtttagggtagtttttttgtaagttgggtgagttattgaagttaaggtgggaggtagttgatattattatttacggtttatgcggaggtggtagaaaggttggatttagtagtaatattaaatttcggattaggtagaaattatttaagattgaggggtttatgttagagcggtggttataggtaagaattcgggtttaggttgtgtggtaggaattttttatgttttagggtttagtatagtaaaggaagattagtcgggttattttggtggttatttgtttttgttttatttgtagagttagaatagtttttttttagtggggattttttttttttgttaaagtaatagcggtttttgttttaattagattattttatttagtggagttacggatgttgttttagtattttaatattgtttagttggtgtttgtttgtgtttatttatattttttaggtcggttttttttgtagtttgggtttggttattttggtttgattgagtattgaggttttttgggtatttagttttattattgtatttgttgtttttagttttattttatcggttttggggttttttttagcggcgttgattatgaagttaatatgtacgtaagtcgttttaggaaattttttaatgaaagtgtcggttacggtggtgtgtaggtggttgagtttagattgtagttgttaagatattagttatttattaagagaaagttaggttgttttaaatttagggttcgcggtaaaaaagtattattttcggtcggggagtttggaagttacgttttgtgggaggttatattggtatttaggttttcgtttgtattgtagaaggagagtcgggtttttttttggagaacgttgcgttttttagttttatatcggttttgttattatataggttgttgaggtaggaggcgggtaagacgtagttgtagatttaaagtaattattagttttgggattttgtgggagaggagtatttttagaatatggaaaagtgtggttattttattattagatagtatatattttatataaataaaaagtcgtatggggaaggaggttggggagggaataaaaaattggtatagatattgatagattggtttttagttttaaggtaatagatgtatattatgagattagaggaggtagagataagggttggatttggttttttt

SEQ ID NO: 92 - DNA, 2311 bp, Artificial Sequence
  chemically treated genomic DNA (Homo sapiens)
tttgtgatattaggaggtatattaagtttttttttgtttttaatatagattagaggggtggtttattattttttcgggtggaggatgtgtggagttagaggtttttgggtggttttttggttggttattagagattttcgggagttagtttgtagggtaggagtataatgacgtggttaggattttagaaaggggttggagtgtttgttttagtttttaggataacggtgtaatggttttagttaggttaggtgttggttgttgttgggaataatttttgagtttcgtgattttatagtgtgggtatgagggtttttattttatagatgagaatattgaggtaagtgtagttttcggttaaaattatttagttgattagtaaaatttagtttacgtttgatagattttatagttcgtagtattttagtaggaagtagggtaatcgatttaggggttaatttatgttttaggtttttgagaaggagttttggggaaggagggcggggtgagcgttataggttggagggttgcgttagggtaggtttcgtaggggcggcgggtatagtttcgttttcgggttcggttttttcgtcgcgcgcgtaggtgagtattatcgtgacggtggcgaaggtggtagcgttgacggggaaggcgcgtagtagcgtggacgttagttttcgtgtgaagacgcgttagttttcggcgcggtagttttggtgtacgtagtttaggatgtcgcggtagcgcggggcgtttcgtagttcgttcgtttgtagtcgcgatttgattacgtttataggataggtagagagttaggatacgatgtttgacgtatcgttcgttaatagtagtttgggtattagtaggcggtcgttcggttcgtagtttagcgttcgcgtgagagcgttataggtgaggaagtagacgtcgaagttgggcgttttacgtagtaacgtggatattatgtttcggttgacgttacgtagattttcgtgttcgtagatttgcgcgaggtagtttagcgagtttttgtaggtgcgcgttgggttcgcgttttgtagttgtagtcgcgttttggttagttttatggggtagtagatgacgtattggatggcgttcgtcgtcgtatttgttaggaattggttgaggggcgagtcgtggtttagggttcggagggtgttgttttgtatttcgaatattagcgcgttgatgaaggtgagttttatgagcggcgagtttaggtttttgtataggtttagtatttgcggggatagagacgttattagagtcggtaacgcgtatttttcgggttttttacgcggaagggggtcgggggatggtagttttagtttattttaggggtttttgaggattaagtagaatttcgttagaatttaggttttgattggttttttggtcgttttgatatttttttttttggttttttggtttggggtggtggtagttcggaagttagttttttattttgtgtttttcgagttttattagtttaggttatttacgtttttttgtttgatgatggatttgaagtagtgtaacgtttcgcggtattgaggtttttttacgttttggatttgaagtcgtatttggaaggagagggtttagtgagaggtaggtaggtaggattagagtatttagttttcgggtttggtgtttaggttgtttaggagggttttttaaggaggtcgggtatttaggtatagtttaagatttttgtaattttagggtagggtgggtcgggtatttatgtttttttaggatggggtgttagtaggtaaatagttaaagggataggttgttggagatagggtagggggtttttaagattttagattaatttaggttaagttttttgtttatattatggttgtatagtgtattgttagtggggtatgaacgattttttgagattggttcgttttttaggtgatgtttgttatattgttgagtgagcggtttatgttttagattaggttgaagggtttttgttttaatgttttattagagattggtttcgaggtaataggcgtaaaaagtgatgagtttggttaggtgtagtggtttacgtttgtaattttaatattttgggaggttgaggtgggtggattatttgaggttaggagtttaagattagtttggttaacgtggcgaaatcgtgtttgtaaaaaaaattagtttagtgtggtggtatacgtttgtaatttttgttatttaggaggttgaggtgggagaattgtttgaattcgtgaggtagaggatgtagtgaggttatgttattgtattttagttt

SEQ ID NO: 93 - DNA, 2311 bp, Artificial Sequence
  chemically treated genomic DNA (Homo sapiens)
aggttggagtgtagtggtatgattttattgtattttttgttttacgggtttaagtaatttttttattttagttttttgagtagtagggattataggcgtatgttattatattaggttaattttttttatagatacgatttcgttacgttggttaggttggttttgaatttttgattttaagtgatttatttattttagttttttaaagtgttgggattataggcgtgagttattgtatttggttaggtttattattttttgcgtttattgtttcgaagttagtttttgatgggatattagggtaggggttttttagtttagtttgggatatgggtcgtttatttagtagtatgataagtattatttggagaacgggttagttttaggaggtcgtttatgttttattggtagtgtattgtgtagttatagtgtaaataagaggtttaatttgaattggtttgagattttggggattttttattttgtttttagtagtttgtttttttagttgtttgtttattggtattttattttgagaaggtatagatattcggtttattttgttttggaattataaaagttttagattgtgtttgagtgttcggtttttttgggagatttttttaggtagtttaagtattagattcgggagttgggtgttttggttttgtttgtttgttttttattggattttttttttttaggtacggttttaggtttagagcgtggagaagttttagtatcgcgggacgttgtattgttttaagtttattattaagtaagagagcgtgagtggtttgggttggtggggttcgggaggtataggatggggaattagttttcgggttgttattattttagattagagagttaggaaggaaggtgttaggacgattaggaggttagttaggatttaggttttaacgaaattttgtttggtttttaggagtttttggggtgggttggggttgttatttttcgattttttttcgcgtggagggttcgggaggtgcgcgttgtcggttttgatggcgtttttgttttcgtaggtgttgggtttgtataagggtttgggttcgtcgtttatggggtttatttttattaacgcgttggtgttcggggtgtagggtaatatttttcgggttttgggttacgattcgttttttaattagtttttggtaggtgcggcggcgggcgttatttagtgcgttatttgttgttttatggagttggttaagacgcggttgtagttgtaggacgcgggtttagcgcgtatttataagggttcgttggattgtttcgcgtagatttacgggtacgagggtttgcgtggcgttaatcggggtatggtgtttacgttgttgcgtgagacgtttagtttcggcgtttatttttttatttatgacgtttttacgcgggcgttgggttgcgagtcgggcgatcgtttgttggtgtttaagttgttgttggcgggcggtacgttaggtatcgtgttttggttttttatttattttgtggacgtggttaagtcgcggttgtaggcggacggattgcggggcgtttcgcgttatcgcggtattttggattgcgtgtattagagttatcgcgtcgagggttggcgcgtttttatacgggggttggcgtttacgttgttgcgcgtttttttcgttaacgttgttattttcgttatcgttacggtggtgtttatttacgcgcgcggcgaggaggtcgggttcgagggcgaggttgtgttcgtcgtttttgcggggtttgttttggcgtagttttttagtttgtgacgtttatttcgttttttttttttagggtttttttttagaaatttgggatataaattggtttttgagtcgattgttttgttttttgttgggatgttgcgagttgtggagtttattagacgtgggttgaattttgttgattagttgggtagttttggtcgagaattgtatttgttttagtgtttttatttatgaaataaggatttttatgtttatattgtagagttacgaagtttagagattatttttagtagtagttagtatttggtttggttgaggttattgtatcgttattttggaaattgaggtagatattttagtttttttttgggattttggttacgttattgtgtttttgttttgtaggttggttttcgggggtttttgatggttaattaaggggttatttagggatttttaattttatatattttttattcgggggggtggtgggttatttttttggtttgtgttagggatagaggaaaatttggtgtgttttttggtgttataga

SEQ ID NO: 94 - DNA, 2271 bp, Artificial Sequence
  chemically treated genomic DNA (Homo sapiens)
agattttagaggtattagagttggagatttttgagttagttaatattattttatttttgattttataaaagggaaattgaggtttagagagaggtttgtttgagtttatatagttagttagtggtagggttggggtgaggatttagggatttgttatttgtgaggcgtttttgtatgttatattgtttttttaagaatgtgtatagttttagagtttgaaggtttaaaatatagggtatagggatatttaaagagtgatttgttttttttagtttttgtattggtaggagttcggaaggataatttttgagtttttttttttaaaattagagtttttgaatttgataatttgattttaaggatgttgatagtaggtgttatgtttgatgtataacgaataataaagtatttatttgtgcgttaggcgtggttttgtatgttttgtatgtattaattttttgagttttataataaattttattagatgggtatgataatttatatttttatttttttaaatgagaaaattgaggtttagagaggttaagtaaattgtttaaggttgtagagttgggaagtagggaagttaggatttgtatgtaggagtttgtatttagaggtcgtgggttaattattgaatagtatcgtttttttgaaggttgggtttttgttatagttttgtttgttttgtttgtgataggaagtagacgtaggtaggtttgagtttgtagtaatttatcgtagtatgtggatttaggttaattttgaggaagtttttttagatttatgagaaaattgttaattataggttttgagttattttaggaggaagtcgtttgggtttaggggagatgagtgtggttaggagtttgggagtagggtgggtttaggtaggatagtataaggatattgatttttagttattttaggtagaggggtagttttggttttcgggtattgtgatttgtttaagattatattgtgagttattaggaaaggaggaattagtgatagtcgtgattttataagttgtttaataagagtttgggtcggataagttattttaatgattagtataggttttaagttttttttggtgggtagaaggtcgtggtttgattgagttggaagttgagaggatacggtttttgtttttttattggaggtataaaggggagatttttattttttattttttcgagtggtttaggttttttttaggttttaggggaagaatcggggttgtgtttgcggtcgattttatatttcggttaaataattttagtttacgttttttttaagatttttgttttttaaagtatttttatatttgttgttggttttgtatataaataatttttcggttgttgttgtgttttattttatagaggtagaaacggagttagtttcggagtgaacgttagttatatttgtttggaaagtggattttagtttttttattttttatttttgcggtatttttttagggtatttttagttatttgatagagaaggaaattgaggtttagagtaggatagggatttgtttagggttttttagagaggtggagagtaggagtttttttatttgtggggtttcgtagatgacgggttatcgtagatatttatatttatataagtacgtacgtatatatattcggggttcgtatatttattatatggtagatggttagggcggtggttgcgatgcggatattgaagtagtagtaggtttggcggatagtggataagcgggggtttatggtgttgtcgtttttttttttgagatattgaaggggaaagagtttggtgtttggagtagggtagagaaggggaagttgttggttgttttttttattttttttttgttttttagataggtagggataaggtcgttatagttggggcggggtagttggggagggggagtggggatagggtagtagtttgttttagagtattttattgttttttgttatttttaggagggggttttagagaggatagattttaatacggttattatgtttttttttgtattagggttagggttttatcgttttatatagtttgtttattagaagaatattattaattttggaagttaggattgttattaagtttatttttagatgaggaaatagttgtttagagaggttaaggtatttgttttaaattatatagtagttagtattggtggtagaatttaaatttagatttgtttggttgtaaaaatagttattgtttaggaggtattttttgtttttttta

SEQ ID NO: 95 - DNA, 2271 bp, Artificial Sequence
  chemically treated genomic DNA (Homo sapiens)
tggaagaggtaggaaatgttttttagataatagttatttttgtagttagatagatttgggtttgaattttgttattagtgttaattattgtgtgatttggggtaagtgttttgatttttttggatagttgtttttttatttggaaatgggtttggtaatagttttggtttttaaagttggtagtgtttttttagtaagtaagttgtgtgaaacggtggaattttggttttggtgtagagaagggtatgatgatcgtgttagggtttgttttttttggaatttttttttgggaatggtagagggtagtggggtgttttgaggtaggttgttgttttgtttttattttttttttttagttgtttcgttttagttgtgacgattttgtttttgtttgtttaaggggtaggaaggaagtgaggagggtagttagtagtttttttttttttgttttgttttaggtattaggtttttttttttttagtgttttagaggaggggacggtagtattatggattttcgtttgtttattgttcgttagatttgttgttgttttaatgttcgtatcgtaattatcgttttggttatttattatgtggtgagtgtgcgggtttcgggtgtgtgtgcgtgcgtgtttgtgtgagtgtgaatgtttgcggtgattcgttatttacggagttttataaatgaaagaatttttgttttttatttttttgggggattttgggtaaatttttgttttgttttgggttttagtttttttttttgttaaatggttgggggtattttggggagatgtcgtaagagtgaggagtaagggagttggaatttattttttaggtaaatgtaattgacgtttatttcgaggttggtttcgtttttgtttttgtgagatggggtatagtagtagtcggaaggttatttgtgtgtaaagttaatagtagatgtgaaagtgttttggaaggtagggattttgggaggaacgtgggttgggattgtttgatcgggatgtgaggtcggtcgtagatatagtttcgattttttttttggggtttggagggagtttgggttattcgaggggatgagaagtggggattttttttttgtgtttttagtggggaggtaggggtcgtgtttttttagtttttagtttagttaaattacggttttttgtttattaaagagaatttgagatttgtgttaattattagggtaatttgttcggtttaagtttttgttgggtaatttgtgaagttacggttgttattggtttttttttttttggtgatttatagtgtggttttgggtaagttatagtgttcgggggttaaggttgtttttttgtttggggtggttgagggttagtgtttttgtattgttttgtttagatttattttatttttaaatttttggttatatttattttttttagatttaagcgatttttttttggggtgatttagggtttgtggttaatagtttttttatgagtttggaagggtttttttaaaattagtttagatttatatgttgcggtgggttgttgtaaatttagatttgtttgcgtttgttttttgttataggtagggtaggtagagttgtggtaagagtttagtttttaggggggcgatgttgtttagtggttagtttacggtttttggatgtagatttttgtatgtaaattttggtttttttgttttttagttttgtagttttgggtaatttatttaatttttttgagttttagtttttttatttaaaaaaatggggatgtgaattattatatttatttgatagggtttgttgtgaggtttagggagttgatatatataaagtatgtagaattacgtttgacgtataggtgagtgttttattattcgttgtgtattagatatggtatttgttgttagtatttttggagttaagttgttagatttaaggattttagttttgggaggaggaatttagaggttgttttttcgagtttttgttaatgtaagagttgagagaagtaaattattttttgagtgtttttgtattttgtattttaggtttttaagttttgagattatgtatatttttagaaggatagtgtggtatgtaggggcgttttataggtagtaagtttttgggtttttattttagttttgttattaattggttgtatgggtttagataagtttttttttgggttttagttttttttttataaagttaggggtaaggtgatgttgattggtttagaggtttttaattttgatgtttttagggttt

SEQ ID NO: 96 - DNA, 2546 bp, Artificial Sequence
  chemically treated genomic DNA (Homo sapiens)
tagttttagtagggattaggtttgggagtgagggcgagttttttgcgcgaattttggagggtcggattttaattttggggttgtgggttttgtttttttttttatttatttatttgtttcgtgagtattaattggatgtttgtaaagtgttagaggtagtttgttttcgaattagtattttttttaagattggatttatttttcgttacgtgtggggaggaaatttttgaattattgaagttagtggttgagtttatattattttagttagtttatagcggttatatttttgttaagtttgttgacgggtagttttattggagcgtagacgttatttttttaggaaatttgtgatgaggattggggtgtatacgtgtgttgaggatattttttaaggtcggtttcggggtttagataggtaggttggggttatatttgagttttttggttttagtgtatttattttggcgtagatagattatggttgagcgtgtggtttcgaattttatttttggaatagaggaagtttttgttatgagaaagaattttagttatagcggatttgtatttgtaggtttgtgttttgcgatatttaagggttaggttggacgggtttttatagaggtggaggagtggtcggttttggttaagttgttagatattattagggaaataggtgtatttatagagtttttgtgtttgttgaggggttgggagtcgtagttttaaggagtaggtttattttgttgttttttgttttaaggtggttttttttttggttggatgagaaaagttagttgagttttttacggattgatttagtagttgagtatgtagaaattggtttggttttggggttagtatgtgagttattttttattatttataggttttttaggaggttttgttttcgtagtagagcggtcgttgttatcgaggtaatggttagattaggaattttaggattttcgggagggtgggatattgcggttttatcggtttttgtgtttatggaatcggtgttagcggatatttcgtttatggtgggatatgttcgtaggtgtcgggtagatgggggagttttaatatcggtttttttagggggttttagtttggaggaaaaaagttttatttttttgatgatggttttattttttaagaacgtattagaatttgttttttagtagttgtttgtggtgtttttagattcgggggtaacgttggttttgtggttcgtttttattttatttaattgtgaacgtttttttattttttgtattgaggtgagatagaggatacggtttttaaggagaggaagaagttgttgggatttttaggttttatgaggtcgggttgtttttgagtttgaggcgatttgtagggttgattgatttttatttattgaggaaggttaggatttaattttagttttattttgtgtagtcgttatgttagatatgtcgttatagattacggtatcgttgtttttttcgaaagtgttgttttgggttcggcggtgtagtttttggtagtttgcgaggttcgggttgttcgtttttttcgtggtataggtttggggatagggtgtgttcgagttagtggttggtttaggaggttatagaggtgtatttgtttttgttttaggcgagtttgggcggttttgggagggtttggggatatagggtgacgtggtgggagggcgttatggtttgttagtttttgattttggggtaggtggttttgtttgtttgttatagaggacggggttttttattttttcgcgagtttttggaggttacgatgtttttggggatattttttttttgggaaggtgagggttggggttgtttttgttgttaggttttggttttaggaaggaggtttgtggttttagtgattaacggatttttttgtttgtttgggagtgtgttgattattagggagtaattagggaattggatttttcgtgtggtaggaggggtattttttagttttcgagtttgattgtttttttagtgtttgagttgtatttttgggattttagtttttttttttcgagttcgggtagtatttgtgttgggttttgttgggatttttttttttatgtgaggtatgttacggttggtattggttttagttcgggtttcgggtgtggtgggtttatagtgtgttagattttgggtgtggtgggtttcgggcgtggtggtttcgggtgtggtggttttgggtatggtgggttttaggtatggtggtttcgggtgtggtgggtttaggcgtggtgggtttcgggcgtggtgggttttagttgtggtggttttgggtatggtgggttcgggtatggtgggtttttggcgtggtggtttcgggtgtggtggttttgggtatggtgggtttgggtatggtgggttcggttatggtggtttcgggtgtggtgggttcgggtgtggtggttttcgaggaggagtgtgttttggagaataggcgggtgcgtgagagtttttagtttagttataagagtaatatatgttgtttatttagtttcgttt

SEQ ID NO: 97 - DNA, 2546 bp, Artificial Sequence
  chemically treated genomic DNA (Homo sapiens)
aggcgaggttgggtgggtagtatgtgttgtttttgtggttgagttgggagtttttacgtattcgtttgttttttaggatatattttttttcgggggttattatattcgggtttattatattcgaggttattatggtcgggtttattatgtttaggtttattatatttagggttattatattcgaggttattacgttagaagtttattatgttcgggtttattatatttaaggttattatagttgaggtttattacgttcgaagtttattacgtttgggtttattatattcgaggttattatgtttgaagtttattatgtttagggttattatattcgaggttattacgttcgaggtttattatatttagggtttgatatattgtgggtttattatattcgaggttcgggttggggttagtgttagtcgtgatatgttttatatgaggaggaaggttttagtagggtttagtatagatgttgttcggattcgggaagggaaagttgggattttaggggtgtagtttaggtattggaaaagtaattaggttcgaaggttgggagatgttttttttgttatacggagagtttagttttttggttattttttggtggttaatatatttttaggtagataagggaattcgttagttattggggttataaattttttttttagggttagagtttggtaatagggatagttttagtttttatttttttaaaggggaggtgtttttaggagtatcgtggtttttaggagttcgcgaggggatggaggatttcgttttttgtggtaggtaggtagaattatttgttttaagattaaaggttgataggttatagcgtttttttattacgttattttgtgtttttaggtttttttagaatcgtttaagttcgtttggagtagaggtaaatgtatttttgtggttttttgagttagttattggttcgggtatattttgtttttaagtttgtgttacgggagaggcgggtagttcgggtttcgtaagttgttaggggttgtatcgtcgggtttaggatagtattttcgggagggataacggtgtcgtggtttgtggcggtatgtttaatatggcggttgtataaagtgaggttgaggttgaattttaattttttttagtggatagaaattagttagttttgtaggtcgttttaggtttagggatagttcggttttatgaagtttgggaattttaataatttttttttttttttgagagtcgtgttttttgttttattttaatgtagggagtaaaagggcgtttatagttaaataaaataaaaacgaattataaagttaacgttgttttcgaatttagaaatattataggtagttattaaggggtagattttagtgcgtttttaaggaatgaaattattattaaggaaataaggttttttttttttaaattgagattttttaaaggagtcggtattgaaatttttttatttgttcgatatttacgggtatattttattatgaacgggatgttcgttgatatcgattttatagatatagggatcggtggagtcgtagtgttttattttttcgggggttttggaatttttgatttggttattgtttcggtgatagcggtcgttttgttgcgggagtagggttttttgggaggtttgtgggtggtgggggatggtttatatgttggttttaggattaggttagtttttatatatttagttgttgagttaattcgtggggggtttaattaattttttttatttaattagaagaaaaattattttaaagtagaaagtaataaaatgagtttgttttttgaggttacgatttttagttttttagtaggtatagaagttttgtgggtgtatttgtttttttggtggtgtttggtagtttggttagagtcggttatttttttatttttgtgggggttcgtttagtttggtttttaagtgtcgtaagatatagatttgtaggtgtaaattcgttgtggttggagtttttttttataataaaaattttttttgttttaaggatggaattcgggattatacgtttagttatggtttgtttgcgttagagtgaatgtattaaaattaggaggtttagatgtggttttagtttgtttgtttgagtttcggggtcggttttggagggtgtttttagtatacgtgtgtattttagtttttattataggttttttgggagggtaacgtttgcgttttagtgaggttgttcgttagtaagtttagtaagggtgtgatcgttgtgggttggttggggtggtgtgaatttagttattgattttagtgatttagaagttttttttttatacgtgacgaggagtgagtttagttttgaagaaagtgttgattcggaagtaaattgtttttggtattttgtagatatttaattgatatttacgggataaatgaatgaatggagggaggggtagagtttatagttttagggttagggttcggttttttagggttcgcgtaaggggttcgtttttatttttaggtttggtttttgttggggttg

SEQ ID NO: 98 - DNA, 2251 bp, Artificial Sequence
  chemically treated genomic DNA (Homo sapiens)
ggatttcgagtcgtttttaggtagttaggagcggttttagcggtagtcgtaaattttagtagtcgttcgtgttgttcgtggttggggcggagggtagttagagttggggattaaggtttcgcgttatttgcgcgtatagttttatatttgaacgttgttttttcgtagacgagatcggcgggtattgtaaagttgggattcgtttttgaaggaaaaaaaatagcgagtaagaaatttagtattattttttattgatttatttcgttgtattttttgttttttaagtttttgaaagttggtaattttgatttcggtgtttaaaaatcgatagttattgagatcggttttgagaagtcgaagatttggtagtttttagattgagtaggataaggtgaaagtaggttggaggcgggtttaggatatttgagggttgattttgggggttcgtgaggttgttatcgttgttgtcgttataggtgagatggcgttgggttgacgttggggttaacgggtagagaacgtagggatgcggttttcgtcgaagagagttaagaagggaagagcgcgttttttaaattgtttttgtaatttgtttttagtgagtattttattgatttagaatttatcgagaatagtattagcgagttattttttttttgagatgggttttatttattttggtaatggagtgagttggattgtggggaggaagaggaatgggaaaattagtttataaatattaatgttagtaagagtgtgttgttggtaggacgtatcgcgagtttggagattttggtggtcgtagttggtaagtggttataatttagaaagtaggatcgagttgttttttttgttttattagtgtatcgtttttcgggcgcgggtttaatattttataagtggtaattttcgtttacggtagttttgttttttttttattatttttagatttagttttgtattttaaggttgcgtatcgttagttattattatgtttattttcggggttaattcgttcgtttttttgagtttcgatcggttgaatagtttagtgattatttcggcggtgatgtttattttcggggtggtgggtaatttggtggttatcgtggtgttgtgtaagtcgcgtaaggagtagaaggagacgattttttatacgttggtatgtgggttggttgttatcgatttgttgggtattttgttggtgagttcggtgattatcgttacgtatatgaagggttaatggttcgggggttagtcgttgtgcgagtatagtatttttattttgtttttttttagtttgttcggttttagtattatttgcgttatgagtgtcgagcgttatttggttattaattatgtttatttttatagttattacgtggataagcgattggcgggttttacgttttttgtagtttatgcgtttaacgtgtttttttgcgcgttgtttaatatgggtttcggtagttcgcggttgtagtatttagatatttggtgttttatcgattggattattaacgtgacggcgtacgtcgtttatttttatatgtacgcgggttttagttttttttttattttcgttatcgttttttgtaacgtgtttgtgtgcggcgcgttgtttcgtatgtatcgttagtttatgcgtcgtatttcgttgggtatcgagtagtattacgcggtcgcggtcgtttcggttgtttttcggggttatttcgttgtttttttagttttgtcgcgttttagcgattttcggcgtcgtcggagttttcgtcgtatcgcgggcgtcgagatttagatggttattttatttattgttatttttttggtggtgtttatttgttttatttcgttcgtggtgagtgatcggggttggggttttattcggtttttttttcgtatttatttttcgcgtttatttttcgttttttgttttttttttgagtttttggtagtgaacgtgtcgtttttaggtcggggttgggatttttatattgttttttagagtaggtttaattttttttgaagttttaattttaacgagatttagtaggtgttttgtttttatattttttagtttatgttttcggaagtttgggtttttttttttatcgagatagtttttattttttgttgtttgatattggtcgagttttttaagaaaatttttcgttttttttgttagacgtggaggggagtttgttgtagtgtgatttagtttattttttcgtattgtgaattgtgaattgta

SEQ ID NO: 99 - DNA, 2251 bp, Artificial Sequence
  chemically treated genomic DNA (Homo sapiens)
tgtagtttatagtttatagtacggaggaatgggttaagttatattatagtaggtttttttttacgtttaatagagggggcggggggtttttttggaagattcggttagtgttaggtagtaaggggtaagggttgtttcggtggagaaagaaatttaggttttcgggaatataaattgggggatgtaggggtaaagtatttgttaaatttcgttagggttgggattttaaagagggttgggtttgttttgagaaatagtgtgggaattttagtttcgatttaaaggcgatacgtttattgttaaggatttagagggaaagtagggagcggggaatggacgcgggaggtggatgcgagaaaaaggtcgagtagggttttagtttcggttatttattacgagcgggatggagtagatgagtattattagggaggtggtaatgagtaagatgattatttggatttcggcgttcgcgatgcggcggaagtttcggcggcgtcgaaagtcgttgaggcgcggtaaggttggggaggtagcggggtggtttcgggaggtaatcgaggcggtcgcggtcgcgtggtgttgttcggtgtttagcgaggtgcggcgtatgaattggcggtgtatgcggagtagcgcgtcgtatataagtacgttgtagaggacggtggcgagaatgaggaaggagttgaagttcgcgtatatgtaggagtaggcggcgtgcgtcgttacgttggtggtttagtcgatgaagtattaggtgtttgggtattgtagtcgcgagttatcgagatttatgttgggtagcgcgtaaaagagtacgttggacgtatagattgtaaagagcgtgaggttcgttaatcgtttgtttacgtagtggttgtagaaataggtatggttgatggttaggtagcgttcgatatttatggcgtagatgatgttgaggtcggataggttgaagaagagtagaatgaaggtgttgtattcgtatagcggttggttttcgggttattggttttttatgtacgtggcgatggttatcgggtttattaataaagtgtttaataggtcggtgatagttagtttatatattagcgtgtagaaggtcgtttttttttgttttttgcgcgatttgtatagtattacgatggttattaggttgtttattatttcgaagatgaatattatcgtcgggatggttattgggttgtttagtcggtcggggtttaaggaggcggacgaattgatttcgggagtggatatgatagtggttggcggtgcgtagttttggagtgtaaggttgggtttggggatggtagaagagagataaagttgtcgtgagcggaaattattatttgtaaggtgttagattcgcgttcgagaaacgatatattgataagataaggggagtaattcgattttattttttggattgtagttatttattaattgcggttattaaaatttttaggttcgcgatacgttttgttaatagtatatttttgttgatattaatatttataaattgatttttttatttttttttttttttataatttaatttattttattgttaagatgaataagatttattttaagggaaaagtagttcgttagtgttattttcgatagattttgaattaataaaatgtttattgaaaataagttataaaagtaatttggagagcgcgtttttttttttttggtttttttcggcgagggtcgtatttttgcgttttttattcgttgattttaacgttagtttaacgttattttatttgtagcggtagtagcggtggtagttttacgagtttttagggttagtttttagatgttttggattcgtttttaatttgtttttattttgttttgtttagtttggaaattgttaaattttcggttttttaaagtcggttttagtggttgtcgatttttggatatcgaggttagagttgttagtttttaaaaatttgggaaataagaggtgtagcgggatgggttagtgaagaatggtgttggattttttattcgttatttttttttttttaaagacgagttttagttttgtagtgttcgtcggtttcgtttgcgggaggatagcgtttaggtgtgaggttgtgcgcgtaggtggcgcggagttttggtttttagttttggttgtttttcgttttagttacgggtagtacgggcggttattggagtttgcggttgtcgttgaggtcgtttttggttatttgggggcggttcggggttt

SEQ ID NO: 100 - DNA, 2413 bp, Artificial Sequence
  chemically treated genomic DNA (Homo sapiens)
tggttaattgggtttaaaggaagatatcggtttaaatattgaaattaattagatttttttacggtttttttgttattagacgatattggtgtaggggtggttgttatgtatagggtagagttatttaatttttacgtaggcgttgtgttttgttacgttggtttttttttggttattatattaggttaagtaggggagaggaatgggaatgtttacgtatttttattaattttgtagatatagaattatgtatagtttttgggaggagttagatgagttgtttaaagtttaggagggattcgtatagtggttagtgtggtagggacggtgttttagttaaggtagggatggtgggtgatttatttaggatttttaaggaggtcgttgtattttcgtgttttttttagataataaggacgtgtcggtgatgatgagcgagatggacgtgaacgttatcgtaggtacgttgaagttgtattttcgtgagttgttcgagtttttttttattgacgagttttattttaatttcgtagagggtatcggtgagtattggaggttttggttttatgggagacgttttttttacgtgtattgttgttttcggaggttgtgaaaagcgaggtgtgggaatttgagttgtaatttttttgtcgtggtcggtattttaatttaattttaaaaagtaggggattagaatcgagtttgttttggaaggttttgtttatttttagagggttttttatttttattttttaaggagattaagaggttgaaatagttagtattgttgtgttatggggttttaaagtttgttgtttttttttttgtagattagggttgaaggagggtgtttgggtgtttttgttatgggttttggtttagttaagtatggttttaaatatgatttgatttttagttaatttggaggttgatgtttagagcgggtgttggtgcgtgtagtatttgtggtttttgtattatttttagggtaggtttgtttttcgggtttatgtatagaggatttggttttttagtttgtaggtgtttttgtggtgtttaggacgacgagggggtttttgtgtatttggtggggttgggatttttttattttttatttttttgtgttttttatttttttgttttattttatgttgagttttttttgttttgggttttttggggagggggtggtggtaggagttgttcgagggtagttttgtttatgagtagttgttttagcggttttttttgttgttgttcgtcgggtgttgttgatttttgcgaggtagagaaaaggcgtttaggtggtttatattttatataggtgttttttatagggtttttattggcggttagcgttgtgggtgtgacgatgatgataagtttaaattgcgtaaggattcgtgtttcgggcgttttatgtgattatttcgggagaggttttcggtttgtcgtaatttaggggagtgatttattgttttttgtagtttttttagatttagttgtaaggaagagttgtatgtttaatttgttgttgtttttgtcggaggttaatttgtttattttttttttttttttagattatttggaaaggtagtttagtttttttgtggttgtttaggattttaggtttttaggtcgttggggtgtttttttgtttttattagatttttagtattaaggattttttttttcgatttttgtttgtagtaatttattgtttttaaggattagtattattgttatttttatttttgttttttttttttgttatttttttttttttgtattgtggttttaataaagagtttagagttttggtcgtggttagtagtgtatttggatttttttttttttttttaagtatattatgaagatttttttattagtttagagttggttttttgttttgggttattgagatttagaagtattaaggttggagttagtttgtagtatagttagggtcgaggttattttttttttgaggattttagtacggtatagtttttttgttttttttttggtggtggcgttgaaatagtattttttgtttcggttttttatagggtggtagagaaggaggcggttaataaggtgtttttgtataatttcgttattgtttttggttttacgttgtttcggtttttcgagaaggagagtaagttttttgttaattttagttagtttgttattatgattgatagtaggtttttggaggttatgttttaggtatgggaagatagtttttagtttatgtaattttagtttgatagaggtggtttttgtttgttttatttttagttttgtttatttttcgatttgtattgtatgtggtggtggttgagatttagagagagggatttgtttaggtttgtatggatgggagtgatagggggtgtttaggttattt

SEQ ID NO: 101 - DNA, 2413 bp, Artificial Sequence
  chemically treated genomic DNA (Homo sapiens)
aggtggtttgggtattttttattatttttatttatgtaaatttaggtaagtttttttttttgaattttagttattattatatataatgtaagtcggaagatgggtaggattgggggtggggtaggtagaggttatttttgttaggttggggttgtatgggttggagattgtttttttatatttgagatatgatttttaaggatttgttgttagttatggtgataggttggttggggttggtagggagtttgttttttttttcggagggtcggagtagcgtggggttaaagatagtggcgaggttgtgtagggatattttattgatcgtttttttttttgttattttgtagaggatcgaagtagagggtgttgttttaacgttattattaggagagaggtagaggggttgtgtcgtgttagagtttttagggagggagtgatttcgattttggttgtgttgtaagttgattttagttttggtatttttgggttttagtggtttaggataaggggttagttttgggttgatggggaggtttttatgatgtgtttgggagggaagaggggggtttaagtgtattgttggttacggttaaagttttgagttttttgttaaggttatagtgtagagggaggagggtggtaaagaggagaggtaggggtgggggtggtagtggtgttagtttttagaagtagtgagttattgtagataggggtcgggggaaaaggtttttggtgttgggggtttggtgggagtagaggggtattttaacggtttggagatttggagttttgggtagttataagagagttgggttatttttttaggtggtttagaaggaaaaggaaggtgagtaggttggttttcggtagggataataataggttgagtatgtagtttttttttgtaattgggtttgaaagagttgtaggaggtagtgggttatttttttgggttacgataagtcggagatttttttcgaggtggttatatggagcgttcgggatacgagtttttgcgtagtttaggtttgttattatcgttatatttatagcgttggtcgttagtgaggattttgtgaggggtatttgtgtggggtgtgaattatttgaacgttttttttttatttcgtaggggttagtagtattcggcgaatagtagtaggaggagtcgttagagtagttgtttatgggtagagttgttttcgggtaatttttgttattattttttttttagggagtttaaggtaggggaggtttagtatggaatgaaataggggagtgagggatataaggaggtgggaagtgggagggttttagttttattaagtatatagagattttttcgtcgttttggatattataggggtatttgtaggttgggagattaggttttttgtgtatgggttcgggaggtagatttgttttaagggtgatgtagaggttataggtgttgtacgtattagtattcgttttagatattagtttttaggttgattaagggttaggttatgtttgaaattatgtttggttggattaggatttatggtaagagtatttaggtatttttttttagttttggtttgtaggaaggaggatagtagattttaggattttatagtatagtagtgttgattattttagttttttggtttttttgaggagtagggatggggagttttttggggatgggtaaggttttttaggataggttcggttttggttttttgttttttgaggttgggttaaaatgtcgattacggtagaggggttatagtttaggtttttatatttcgttttttatagttttcgagggtagtagtgtacgtggaggagacgttttttatgaggttaaggtttttagtgtttatcgatgttttttgcgaagttggggtagaattcgttagtgaagaggggttcgggtagtttacggaagtatagttttagcgtgtttgcgatggcgtttacgtttatttcgtttattattatcgatacgtttttgttatttggaaagagtacggaaatgtagcggtttttttgaagattttgagtgagttatttattatttttgttttggttaaagtatcgtttttgttatattgattattgtgcgggttttttttgggttttgagtagtttatttgattttttttaagagttgtgtatggttttgtgtttgtagagttgataggggtgcgtgggtatttttattttttttttttgtttggtttgatgtgatggttaggaggaggttaacgtggtaggatatagcgtttgcgtggggattgggtggttttgttttgtatatagtaattatttttgtattagtgtcgtttgatagtaggaaggtcgtgggagaatttgattggttttagtgtttgaatcggtgtttttttttggatttaattggtta

SEQ ID NO: 102 - DNA, 2222 bp, Artificial Sequence
  chemically treated genomic DNA (Homo sapiens)
tttattaagaaaatatttgtttataataatggtgtagaatgaaaagaggaaaatgttgtttttattattaaggtgaaattgtttattattaaaggttttttttaagtcgtatgtaagtttttttatttggaagtgttattatttgtaataattttttgtaatagtttattggtttagggagttaaaatattatattgtgggtgggaggtgggggttggtttgaaggaggatggatagtgagggtgttttgtggattttaaatgtaagttattaggtttttggtggtttttggtgtttaattttattttataaaagtggtatgatggaatatgattaggtaaaattttattttttggtattgtggtggtatttttttttttttttttttttattagggttaatatgtttatttttatgggaaatatatataaatattaggaagatttgtttcgtattgagattaatagtattagttttgtaaaagtagtttgataaaaggttttatatatttaatattagagattagaaatagattaaaaaaaaaaaaaaaaaaaaatatatattatataattggtaaatttattaatttaggtttatttaattttcgtttttatatacgcgttttaaaataatttataataaaaatggaagggaagatagatttaatttgaaattttttttgagaaaaaataaattaaaattagtttttggggaagaaagttttagttaggttaggaggaaatttacgtatttttgatttttttttcgttttggagaggtattattcgtttaagtttagttaatgcggtcggttaggatttatagtttttattaagggttagattttgcgaaagatataaagaaaggagttttttaatatatcgggtttttttatagtaataagatatcgaaattaagttttttatggtttgtgtttgtaggattttttagataaaattggtagttttattagataagaaatggttttttagaagttttgggggaagcgcgggggtttttcgtggtttttttgtgattgtttttgggagatcgtaatagatgatgggaatatgtaagaatgattgaagaaggttatcggcgagttgtatttaatagttttttttttttaagtagtttttcgagagaaaattatatattaacgtttggggacgtgaaataggttttttattgttttgtaataaatttttttttattcgcgtttttagattaatgtatttttaaaaaatttttataaagttatggagatttgtttttataattattaaaatattatagttagttgtataagtttgtttaaaaataaagggtaggagattagtagtgagaagaattgaatagtatataaaaattttataaattttagattattgaaagattatttcgttttttggtttcgggttagtgagttttaattttagagttaaattgagaagtagatttcgcgggtttgaaagataaaaagttagttcgcggagttaatttcggtttatcggtgcgttttaatttgattgttttaatagtaagaagcgtttttttttttttatttaacgtttttagatatttgaggttgggggagacggagtaatggtgtagtagttaggaaatagtttttttgggtttaattattttattttcgatttttttttttttagcgcgtcgagcgtagttagttttggaggaattagtttttcggagtagttaaggtaggttaggtttcggggatgtgtattacggcgtggggattaaattaagttgaacggtttgttttaagtttttttttttttttagagttcgggagggatttcgttaataggtagatttatttattagttattcgttatcggcggtagaaagtgagtttcgcgcgtaacgcggttagtcggattgcggggattttaggagcgtagggcggaggagtagcgttataggaggcgagggcgtaggcggcgcggtcgggaaggaacgcgggaggggatagaaggaagaggaagaggaggagagggaggttagagttagaatagttcggtagttcgagtttcgggggagaacggtttgagtttcgagtaagttgtttcgggagttttaattttttttcgttggttcgtcgagcggttagtggcgtttagcggcggcgaggttgaaatatgataattagaatagttgcgtcgcgcgttttgtagttaatgggcgcggcgttcgtt

SEQ ID NO: 103 - DNA, 2222 bp, Artificial Sequence
  chemically treated genomic DNA (Homo sapiens)
ggcgagcgtcgcgtttattggttgtagggcgcgcggcgtagttgttttgattattatattttagtttcgtcgtcgttgagcgttattgatcgttcggcgagttagcgggagaggattagggttttcgaggtaatttgttcggggtttaggtcgttttttttcgaagttcgggttgtcgggttgttttggttttggttttttttttttttttttttttttttttttgttttttttcgcgttttttttcggtcgcgtcgtttgcgttttcgttttttgtggcgttgttttttcgttttgcgtttttggggttttcgtagttcggttggtcgcgttgcgcgcggggtttattttttgtcgtcggtggcgagtggttggtgggtaggtttatttgttgacgaggtttttttcgggttttaggaaaaggggggaatttggagtaggtcgtttagtttggtttggtttttacgtcgtggtgtatattttcggggtttggtttgttttggttgtttcggagggttagtttttttagaattggttgcgttcggcgcgttaggggaagaagaatcgggaatgggatgattaaatttagaggaattgttttttgattgttatattattatttcgttttttttaattttagatatttaaaaacgttgggtgggaggaaaggggcgttttttgttgttgggataattaggttggaacgtatcggtaaatcgaagttgatttcgcggattgattttttgttttttagattcgcgaggtttgttttttagtttaattttagaattgaagtttattaattcgaagttaaagagcgaaatgattttttagtagtttaaagtttgtaagatttttatatattgtttaattttttttattgttggttttttgttttttgtttttaagtaaatttgtgtaattagttgtggtattttggtaattataaggataagtttttatgattttgtggagattttttaaaaatgtattagtttaagggcgcgagtagggagggatttattatagaatagtgaaagatttattttacgtttttaggcgttaatatataattttttttcgagaaattatttggagagagaagattgttaggtgtaattcgtcggtaattttttttaattatttttatatgtttttattatttgttacggttttttaaagatagttataggaaggttacgaagaattttcgcgttttttttaaagtttttaaaaagttattttttatttaatggggttgttagttttatttaaaaagttttatagatataaattatagaaggtttaatttcggtgttttgttgttgtgagaagattcggtgtgttaggaaatttttttttttatatttttcgtaaaatttaatttttgataagagttgtaaattttggtcggtcgtattggttgggtttgaacgggtaatgtttttttaaagcggaaagggaattaaagatgcgtaagtttttttttgatttagttgaggtttttttttttaggaattagttttgatttgtttttttttaaggaggattttaaattggatttgtttttttttttatttttattataagttgttttagagcgcgtgtatgaaagcgaaagttggatagatttaggttgataagtttattagttgtgtggtgtgtgtttttttttttttttttttttggtttgtttttagtttttggtattagatgtatggagttttttgttaggttgtttttgtaaagttgatgttgttaattttaatacgaagtaaatttttttagtatttgtgtgtgttttttatagagataaatatgttgattttagtaaaaaaaaaaaaaaaaaaagatattattataatgttagaaaatagagttttatttagttatattttattatgttatttttataagatggaattaaatattagaagttattagaagtttgatgatttatatttgagatttataaagtatttttattatttatttttttttaaattagtttttattttttatttatagtgtggtattttaattttttaaattaataagttattataaagaattattgtagatgatagtatttttaagtagaaaagtttgtatgcggtttgggggaaatttttagtaatagataattttattttaatggtgaagataatatttttttttttttattttgtattattgttgtaaataagtatttttttaataag

SEQ ID NO: 104 - DNA, 2162 bp, Artificial Sequence
  chemically treated genomic DNA (Homo sapiens)
tggatttagaaagggtgaattatgagggagttggagggttttgttttattttttttcgcgcgtatacgtaagtataggtagaggtatatattttttttaagttaaagttgtgagtggggtggtgtttgcgcgtttgtggttgggattggatgtgttagggatgggaaaatttattatgttggttatagaaaatgcgcggtggggatagaagtagttttgaaggaaaagaagaggagggggattgaaagaaagaagggggcgttgaaagggagggcgttgggaggaaaaaggtgtagtgtggaggaagcgcggcgtgggtagggtttgggaagggataacggaatatttgaggtggagtgggtcgtggagcgtcggggtcggtttgagtagcgggtgtgtaaatggaatagtttcgagatgaattttatgggagtttgcgtaggtttttaatgtgtggttgtattttttagttttatgtattttatacgatggatagatagttttggtgtggtagggtttaaagaggttttatttatcgtaataatacgattaggcggttttgggggcgtaggggttcggggtgggagcggcggagcgcgcggagtcgtcgcggggtggtaggggtgggtcgggggcggggtcgcgggcgtcggggaggtggtagtgggcgtagggcggggcgagtttagcggagggcgggtttgaatgtgtttcggcgggagagggaagttgtagcgagagcgcgcggattttagcgcgggagtagtgtttttgcggtaggtgttgttcggggtcggggattggggattggggattgtcggggcggaagacgtcgttgttcgtttgttacggagggtagggagggcgggtttgacggtttcgtagttcggagaagggacgtcgggtggggttttagtgcggagcgtgcggagtcgcgtagtacgtggcgcgtacgggttagggagtttgaggattttgcggggatcgggatttaagttgggcggggcggtttggttttcgggtttaaaataggttgcggttacgttgattttcgtaaggggtaggcgagtggacgggtgatttttatcgatttggtcggtattagggaggggtcgtgtcgttgattgcgttggcggaggggtatggggatggggatggggatggaggttcgcgagcggaggtgtaggttcgcgagcggaggtgcggggttgtttttttaatttcggttttttattggttaaattcgtatttttggcgttttttttttgcgtacgtttttatttattgatttattgtgagggtatatgagagggtgaagataaatagttttcggttttgtttattaggagagagtagtcgtaggttaaggttggttttaattttgtttttatatttttaggggtttttttgtagttttgtggtagtttttttgtttatttttttcggtggtttttagattttttaattttttttttgtttgtgtaagttttttatgttaggatgtgtgtgatggggcggggttgagttgtttgatatttaagttaggttgggaatgattttggtttttattttatttttttttttagttgaattagagttttttttattttttagtttatagggttaattgagaagtagtttttatatttttttttattttaaaaggagtttgaatatttaatatggattttagtttttttatttattagttttgtgattttaggtaagtgatttaatttttttgaattttagttggttttatttatttagtgttagtattagtttatgggtggttgtgaagaaaagataagagatttgtaggtagtggttagttttatatgaaattttgggagtggagaattgtaggagaggtgttgggagtttggaggtagggaggtatttaatttggtggttatttttaggggtttattttagtaggttaaggtatagttggagggatattagatgttttgagttggtattagatttttgtttgtcgttgggtaaaggtagataaaagtaaaatacgaaggttggttagttgaatgttaggatatgggtaggaggagagggttggagttgaattgtgtttaagattggtatgggaatttttgagaatagagagagtaggggtgtagtagggggttagggaagaaataaat

SEQ ID NO: 105 - DNA, 2162 bp, Artificial Sequence
  chemically treated genomic DNA (Homo sapiens)
atttattttttttttggttttttgttatatttttgttttttttgtttttaggagtttttatattagttttgggtataatttaattttagttttttttttttgtttatattttaatatttagttggttagttttcgtgttttgtttttgtttgtttttgtttagcggtaaatagggatttgatattagtttagagtatttggtgtttttttaattatgttttggtttgttgaggtgggtttttgaaagtagttattaaattgagtatttttttgtttttagatttttaatattttttttgtaattttttatttttaggattttatatggggttagttattatttgtagattttttgttttttttttataattatttataagttagtattagtattgaatagatggggttagttgaggtttagaggggttgagttatttgtttgaagttatagagttggtgagtggaggagttagaatttatattaaatgtttaagttttttttggaatggagagaggtataaaagttgttttttagttagttttgtagattgggaggtggggggaattttgatttaattaaagggaaaaatgaggtggagattaagattatttttagtttgatttgagtgttaggtagtttagtttcgttttattatatatattttggtatggggagtttatataagtaggaggaaagttggagggtttggaggttatcgagaggagtaggtaaagggattattatagggttgtagagagatttttagaggtgtgagggtagggttggagttagttttgatttacgattgtttttttttggtaagtaaagtcgaggattgtttgtttttatttttttatatatttttatagtaaattagtaaatgaagacgtgcgtaggaaggagacgttagggatacgagtttagttagtaaaagatcggggttaaagagatagtttcgtattttcgttcgcgagtttgtattttcgttcgcgagtttttatttttatttttatttttatattttttcgttagcgtagttagcggtacggtttttttttgatatcgattagatcgatggggattattcgtttattcgtttgttttttgcggaggttaacgtgatcgtagtttgttttaggttcgggagttaggtcgtttcgtttagtttgggtttcggttttcgtagggtttttaggttttttggttcgtgcgcgttacgtgttgcgcggtttcgtacgtttcgtattggggttttattcggcgtttttttttcgggttgcggagtcgttaggttcgttttttttgtttttcgtggtaggcgggtagcggcgtttttcgtttcggtagtttttagtttttagttttcggtttcgggtagtatttgtcgtagaagtattgttttcgcgttgagattcgcgcgttttcgttgtagtttttttttttcgtcggggtatatttaaattcgtttttcgttgagttcgtttcgttttgcgtttattgttattttttcgacgttcgcggtttcgttttcggtttatttttgttatttcgcggcgatttcgcgcgtttcgtcgtttttatttcgagtttttgcgtttttagggtcgtttggtcgtgttattgcggtagataggatttttttgggttttgttatattaaggttgtttgtttatcgtgtggggtatatggggttggagggtatagttatatattaaggatttgcgtagatttttataaaatttatttcgggattgttttatttatatattcgttgtttagatcggtttcgacgttttacggtttattttattttagatatttcgttatttttttttaagttttgtttacgtcgcgttttttttatattgtatttttttttttttagcgtttttttttttagcgttttttttttttttttagtttttttttttttttttttttttaaaattgtttttgtttttatcgcgtattttttgtgattagtatgatgggtttttttatttttgatatatttagttttagttatagacgcgtaaatattattttatttataattttgatttggagggggtatgtgtttttgtttgtgtttgcgtgtgcgcgcggaggggggtggggtaaagttttttagtttttttataatttattttttttaaattta

SEQ ID NO: 106 - DNA, 2586 bp, Artificial Sequence
  chemically treated genomic DNA (Homo sapiens)
ttcgcgcgggcgcgggagtagtttcgttgggcgttcgtagtcgcgggagttaagttttttttttaggtgtaggtataaaagtttatggtttttgaataatgcggggtagaggtttttttaagtaacgtttaattggtcgtttttaattaaggaaagagaggtttttagttttatggtaatttaagtagggtagttttaggttaaaggtattttagaataataagattattttaagaaatggaatgttttattggatattcgaataggttttttgttattggaattggtgtgtattgtattttaattagtatttttgtgtggagggaggcgatttagtttaggaaagttaattatagaaagaggtgattttcgaaaggattgttttagcgttattagaatatatgtgattatattaaaagtttaggcggatattcgtagttagttcggatttggataatttaatattgttggtagaattgaagggaataagttattttaattttattttttgtacgcgtagtgttgagtgagttgggggtgggaggatagcggttcgtttattgtttttttttaaaatttgagatttgaaaatatggaggttttattcgtttttttagtttttgattgttaataaaaaaataaatttcgttggttatattttttttttattttaaaatagtaattttatggtttgtattaagttttttagaagtttattttatttgttttgggttagggagggaataatgttaggaaaagttatcggtgtttttttattttcgttttttttagggtgtaggatgtgcgggtcggcgggtttgtgatttcggaacgttttttgttatttttttgcgcgaatttgaaaggattgggaggtgttgagagtagagtttagggttggtgtattttgcggtgttgagtgggcggcgcgttcgggcgtttaggtcgggggatttgtagtcgttttatcgcggaggggaaaatacgtagttggagggcgtgcgtcgtgcgggttgtgattcgttattttatcggttattttggggtttttttaagtttttaggtagggttgtgagagttttttagagttgaagtttcggaggttgatttgtgggtttggttgttatgggaattcggttggtttaaagaagtttttttttcgggtatttggaattttagtttagtgtggggtatcggggaagtggcgttggggggttgggttgggggattttagtcggtagtttcggagagggtttatttttggggtcgttgggtgaggtcggtacgatttttggttttaaaaggaaagtttttgttttttgttttggcgcgagaagttaaagatttattttgagagcggagagagaaatgttattggtaacgttttttttggaaagttcgagaggggttttttggatatattatttagtgtttttaaattagagaagtagtttttttttggtgtttgggtttagaagtcgttatttatttagtttatggttcgaaattagtatgggaagcgtcggggtaaggtttcgtcggagattagaggtttgtttgtcgggaggagtttttgggggatggggattttatttttttgtttgttttggtttttatttgggacgttttcgtaggagtttagaaagacgatttattatatggtttcgggatagagtagcgcgtttaattttgagggaattttgtgcgtttttttgaggttttagttttttaaggtatcgtcgttcgtttttttttttttagatcgaaattggggaagagtgtgggcgtttttttgtttcgatgagttcgtttttttaaacgtttatttcggttgtattagagtatttgggaaattttgaaaggtgtttaggttttatatagtagcgtttttttatttagtttttgtttttgggtttttttaagagagtttttattttatgtttcggttttttttcgatgtcgggttttcgaggtaggtacggagtttttttgaaagtagttgtttatttgtgtttttttggtgtaaagttagagtttattttgttgggggaaggggaggtagaaaagattatagttgggaaagtgcgtttttcgttttgtttttaaaatatgttttaagattgttatcgcgattgttaggagagttattaacgtttaggggttataaaggaatttttgaattttcggttttttttaaatttttaggtttttaaaattttagtgggggttttttggggttgggatttaggttggtatcgttgggaggatttcgtttagtatttttttattaatattttacgaaggtaggtttttgttttttttggagttttttttttcggaatgtttttaaattttggttaatttatttttttgtgagttattttagggttttgtggttcgggaagagacgcgttaatttcgcgggtttgcgcgtagtttttagtcgtaaagtgttgtaagtgatttttttgacggtttttttcgatcgaagagttcgggaattaaagagaaaaaaaataattttatttttaaaagaataagttattattgcggcgatattgtggcggaggattttggcgatggggt

SEQ ID NO: 107 - DNA, 2586 bp, Artificial Sequence
  chemically treated genomic DNA (Homo sapiens)
attttatcgttaaagtttttcgttatagtatcgtcgtagtgatgatttgtttttttgaaaataaagttattttttttttttttggttttcgagtttttcggtcggaaagggtcgttaggggggttatttgtagtattttgcggttaaggattgcgcgtagattcgcggagttgacgcgttttttttcgggttatagagttttaggatggtttataggggagtgagttagttagagtttgggaatatttcgagaaaagaggttttagagaaggtaggagtttgttttcgtgaaatattaataaagggatgttaggcgaggtttttttagcggtgttagtttgaattttagttttaagagatttttattagggttttaggaatttgggggtttgggaagggtcgagggtttagaaatttttttatagtttttagacgttgatagtttttttaataatcgcgatgatagttttgaggtatgttttaggaataaggcgaaaagcgtatttttttaattgtgattttttttattttttttttttttaataaagtaaattttaattttatattaaaggggtatagataggtaattgtttttagagggatttcgtgtttatttcggggattcgatatcgaagaaagatcgaggtatgaggtagagatttttttgaaaaaatttaaagatagaggttgagtagggagacgttgttgtgtgaggtttgggtattttttagagttttttagatgttttggtgtagtcgaagtaggcgtttggggaggcgaatttatcggggtaaagaagcgtttatatttttttttagtttcggtttagggaaagaagaacggacggcggtgttttggaaagttagggttttagagaggcgtataaagtttttttaaagttgggcgcgttgttttgtttcgggattatgtagtggatcgtttttttgggtttttacggaggcgttttaggtgggaattagagtaagtaggagaatggggtttttattttttaggggtttttttcgataggtaggtttttagttttcgacgaagttttgtttcggcgttttttatgttgatttcgaattatgggttgagtgagtggcgatttttgagtttaggtattaaagaaaaattatttttttggtttgggggtattaggtagtgtgtttagaagatttttttcgaattttttaaagaaaacgttattaataatattttttttttcgtttttaaaataagtttttggtttttcgcgttagaataagaagtagaaattttttttttggagttaagaatcgtgtcggttttatttagcgattttaagggtaggtttttttcggagttgtcggttgaggttttttaatttagttttttagcgttattttttcgatgttttatattaaattggaattttaggtgttcggaagaaaggtttttttggattaatcgggtttttatagtagttagatttataggttagttttcggggttttagttttaggggatttttatagttttatttagaggtttggggagattttaggatgatcgatggggtaacggattataattcgtacggcgtacgttttttagttacgtattttttttttcgcggtagggcgattataggtttttcggtttgagcgttcgggcgcgtcgtttatttagtatcgtagagtgtattagttttgaattttgtttttaatattttttagtttttttaagttcgcgtaaggggatggtaggaagcgtttcgggattataggttcgtcggttcgtatattttgtattttggaaggggcgaggatggaagagtatcggtgattttttttagtattgttttttttttggtttagagtaaatgagataaatttttgaagggtttaatataagttatagggttgttattttggaatgaggagaaaatgtagttagcgggatttgtttttttgttggtaattaagagttgggaaaacgaatgggatttttatatttttagattttagattttaaaagggggtaataaacgaatcgttgtttttttatttttaatttatttagtattacgcgtataggggatggggttggggtaatttgttttttttagttttgttagtaatgttgaattgtttaaattcgagttggttgcgggtgttcgtttgggtttttggtgtggttatatgtattttaatagcgttaagataattttttcggaggttatttttttttgtagttgatttttttagattgggtcgtttttttttatataagagtattggttgaagtatagtatatattaattttaatgatagagaatttgttcgggtgtttagtgagatattttattttttagaatgattttattattttaaagtatttttagtttgaagttgttttgtttgggttgttatagagttggaagtttttttttttttaattagaagcggttaattagacgttgtttggaaaaatttttgtttcgtattgtttaagagttataaatttttatgtttgtatttggggagggggtttgattttcgcggttgcgagcgtttagcggggttattttcgcgttcgcgcggg

SEQ ID NO: 108 - DNA, 2257 bp, Artificial Sequence
  chemically treated genomic DNA (Homo sapiens)
gtcgggttagtttggatcgtggagttgtgtttttaacgggaattttggagggtaggattttgattttttttcgaatttttaaataggagtttgaatagaaatatgtggatttagggattagtgtttcgggtatattttgatagcgatatagttgtttcgatagggttgtggtttttttcgtttcgttttttttttgtgtttttttttatatttttaggggtcgtttgttgttagttttttcgttgtggttttatttagtttttgttggcgtggtttgatttttaaatgtgtgttagtaaggtttgtgttggagggaggggagggtttggatgggtttggatgggttggtgttagtattcgggattaaggagggagtttgtagaagggatagttttcggttaggtgggatttgaacgatattttgcggtatttaatgggtttgaggtgtttgcgtgattatgaggagaagcggaggatagtttaggtgaggatattagatttaggagtgggtgaggagtttttgtagttaggttatgtgaattttggtttagtagggttagtttgattttttgaaggtgggagattttttgaaggtgggagatttgtgagttggtatatttagtgaggacggttttatgtatagggacgaagattttcgaggagattatcgaaggatggtgggtagtgttgtttatacggatgtttagagcgtgttttttaagattagcgggttttatgttgtttatacgtttttattaggcgatcgatattagggttcgtttgtgttttgtttgggtggggttagttacgttttcggattattgttttaattagcgttcgtcgttagttttttatacgggatagggtattgtagatcggttcgggaatttggggatattttacgttttatattttttattgttttttttgtattagaatagtttaggggaaggaaaggtatagaaaataaataatatatagtagaggaggttttgtttttgttcgatcgaaggtaattttttttttgaagagaaaggtgtagataggttttttttttttttttttttttttattttatttaattttgggtatttttttagtttgaaatttgtttgagcgagataagagatattgcgggtttaacgtgtttgtgaggttttttttttattggtttttcgtgtttttatgttttagttaaatataaaagcgagacgttttttgtttagtttttttaattttgtttagttttcgcgtttttttaagttttatttgtagaaggttgagttttatgtatttgtattttttttttttggtgtttgcgtttaaatgtgtggttttgtttggtttaatttttttttgggtttcgtggttgagttggtttgttttttagttttagttttattttttggtttttttagtttcgtattgtttggttggttttttagttatttggttttgtattgtttagttatgttattttttcggttttcgggttttgtattgttcggttagttttttcgttttttggttttgtattgtttagttatgttattttttcggttttcgggttttgtattgttcggtcggttttttcgttttttggttttgtattgtttggttggttttttagtatttgtttgggtttttttatttttttgtagattttaggttgtgtttagagagagttgagttcggcggtttaggcgttttattattggtttttagtttttttttttttcggtagtttttatgagagttttaaaggaattttttagcgaagttgtttttttgtttttggagttttggaatatattacgttgtgtttttgagcgtcgtttttggggtcgtgtgttttttattattttttttttgggttttgagtttttgtagattgagtagggttttgtatttgattttggttgatcggaggttttgaggtaagttatttaattttttagaattgtttttttagtttgtaatagagtggttagaacggagggttttttgggtttttttttatttagtgaaaagttttttgtgggtttttttgagttttaggatagttcgtgagtgaagttgttatttttgtatttgggagtgtttttgtttgttttttattattttgtagttatagattttttatttgtttttcggtagagtaggaagatgtagtaggaggatggggtttttttgttttgtttttataatttacgtttggtaggtagtaggtgttaaattagtattagcgtggatttag

SEQ ID NO: 109 - DNA, 2257 bp, Artificial Sequence
  chemically treated genomic DNA (Homo sapiens)
ttggatttacgttgatgttggtttggtatttgttgtttgttaggcgtgggttgtgagagtaaaatagagaagttttatttttttgttgtatttttttgttttgtcgagagataggtaaggagtttgtggttgtagggtggtggagagtagataaggatatttttagatgtagagatggtagttttatttacgggttgttttggggtttaggaggatttatagaaagttttttattgaatggaagggggtttaaggggtttttcgttttgattattttgttgtaagttgaggaagtagttttgggaggttgggtgatttgttttaaggttttcggttagttagagttagatgtagaattttgtttagtttgtaaaggtttagggtttagagggaggatggtggaaggtatacggttttagggacggcgtttagaggtatagcgtggtgtgttttagggttttagggatagaggggtagtttcgttggggagtttttttggggtttttatggaaattatcggaggaagaggaaattgagggttagtggtgaggcgtttgggtcgtcgagtttagttttttttgggtatagtttggagtttgtagggaagtgggagaatttaggtaggtgttggaggattagttaggtagtgtagaattagagggcggggagatcggtcgggtagtataggattcgggggtcgaagggatggtatggttgggtagtgtagaattagagggcggggagattggtcgggtagtataggattcgggggtcgaggggatggtatggttgggtagtgtagaattagatggttgggggattagttaggtagtgcgggattaagagggttagggaatggagttggaattgaagaataggttagtttagttacggggtttaggagagggttgagttagatagagttatatatttgggcgtaggtattaagagaaggaggtgtaggtgtatgaggtttagttttttgtagatgagatttagggggacgcgagggttgggtagaattgggaaagttgagtaggagacgtttcgtttttatgtttggttgaaatatgaaaatacgaagggttagtgggaaagggattttatagatacgttgggttcgtagtgttttttgtttcgtttaggtaagttttaggttgaaaaagtgtttagaattgggtgaggtgggaggagggaaggggagagggagtttgtttgtatttttttttttaagggagaagttgttttcggtcgggtaggagtagggttttttttgttgtgtgttgtttattttttgtgttttttttttttttgagttattttggtgtaagagaaatagtgagggatgtggggcgtgaggtgtttttaggttttcgggtcggtttgtagtgttttgtttcgtgtaaggggttgacgacgaacgttggttggagtagtggttcgggggcgtggttgattttatttaggtagggtataggcggattttggtgtcgatcgtttggtgggagcgtgtggatagtatgagattcgttggttttggggaatacgttttgggtattcgtgtgggtagtattgtttattatttttcgatggttttttcgggggttttcgtttttgtgtatggagtcgtttttattgagtgtattagtttataggttttttatttttaaggggttttttatttttaaggggttaggttgattttgttgagttagggtttatatagtttggttgtaggggttttttatttatttttgggtttgatgtttttatttgggttgtttttcgtttttttttatggttacgtagatattttaggtttattggatgtcgtaaaatgtcgtttaggttttatttggtcgagggttgttttttttgtaagttttttttttggtttcgggtgttggtattagtttatttaggtttatttaggtttttttttttttttaatataggttttgttggtatatatttaggggttagattacgttagtaggagttggatgaggttatagcgagggagttggtagtaggcggtttttgagaatgtgggagagaatataggagagagacggggcggggggggttatagttttgtcggggtagttgtgtcgttgttaggatgtgttcgaagtattggtttttgagtttatatgtttttgtttaaatttttgtttggaaattcgggaggggattaaagttttgttttttaaggttttcgttggagatatagttttacggtttaggttggttcggt

SEQ ID NO: 110 - DNA, 2352 bp, Artificial Sequence
  chemically treated genomic DNA (Homo sapiens)
cgtttttgttgcggtcgacgttttagtttttgtttttgtttttatagggtttgttttgtgtatttgtttttattttgttttgttttttatggaggaatattagtgattgatttgggatttagttttaatttagggtgatttcgtttttagatttttaattatatttgtaaagttttattattagggaaggttgtattttgaggttttgggcggatatgaattttgggggtaggatattgtttagtttagtgtcgggcgtcgttgtgggttaggttttttgatttttgtaagtttacgatggttatagagttttaaggaggaggttttttggaggaggcggtttagtttattagagaattagtatgttttttttttgggttttgggattagtatttttaacgataagtttttttggattacgttgattcgggttgagatttgtcgtttgtcgcgcgttttgggcggaggttagataggtcgcgtatttttaagttttgatacgttttttttttaaagggtggaggttttatagggtgagtgtaggttggggatgggtcgtggggttgtcgggaggggattagtgggggtttgtagtgttttcgggagggttcggggttgggggtaatcgagatttgtttcggtgggtgagtggagaagtatttggggggttttttttagcgttggagagaaatgggtgatgaagtttgggaaaggcgtggggggttcgaagcgtgtattacggtgagaaggttgcgcgtggtcggattttagttttttcgcgtttgcgaaaggttgagttgcgtcggtcgggggagggtcggaggttgtcgggggttgggggatgaagagtcgggggtagtttagggtagcgtatttttcgcggaggtaggaacggtaggcggtgcgatttttattaggatttttgttatcggaatcgcgggtttttgtcgggtcggaggcgtttgagagattttcgcggaacggcgcgtgaatttgcggtcgcggcggcgggttcggatggagatggacgttggatgggttgttttttgagtttggttttcgtggcggggtcggtttttcgtttttgtatttggtagatttgatgcggagttcgagggtggttgttggtttggggcggggaaggggttttttagatcgggggttttatttgttgggtttggggagtttatttggttttttttgattggtttggagttgtaggtgaggttattttaggaagttgttgtatttgagggagttcgggtcgttttgggggacgttggggtttgatttttggggttgggggttgtacgggtgggtcggggtttgtttgggttggggttcgcggtcgcgtggggtttggattggcgtttgtttggtttgggggtttttagtcgtatgtagtttgggtcgaggtcgggggttcgcggtcgcgtggggtttgggtcggggtttgtttggtttgggggtttttagtcgtatgtagttcgggtcgaggtttgtagttgcgtggggttcggtttttatggtttttgtgtttggatttcgttttttaattattttttttgtacgtttttttggaaaaggatatggggtttagggtggtggatgtggatattttttgaaatttattagttttggtttgtgatgtttggatggaggggttatagttacgtcggtttttagtttttttttagatattttagtttttggaggtagggttttttcgtgaggcgtattatttttgagcgttttatacgtttgtttttgggtatttttttgggtggtggtgtggtgcggttttgcgtttttatttaaattttatatggaaatggagtttgtagtgtgacggtggggtttggtggggagtgattgggtagtaggggcggatttttcgtgaatggtttggtttcgttttttttggtgttgttttcgagattgtgagtggttatttaattgtgtttcgtatttgttttgtttttttcgttttcgtttacgttatgtgagatatttgttttcgtttcgttttttattacggttggaagttttttggggtttttttagaagtagaaatatttgtgttttttatatagtttataaagcgtgagttaattaaatttttttttttataaattatttagttttagggttttttttgtttgtttgtttgtttgttttggtggaggcgggggtggatagcgtttttttttgtcgtttaggagggagtgtagtggggcgattttagtttaatgtattttttgtttttgggttgaagtgatttttttgttttagttttttgagtagttgggattatagttatgtgttattatgtttggttaatttttatatttt

SEQ ID NO: 111 - DNA, 2352 bp, Artificial Sequence
  chemically treated genomic DNA (Homo sapiens)
aaagtataaaaattagttaggtatggtggtatataattgtaattttagttatttaggaggttgaggtaggagaattattttaatttaggagtagagggtgtattgagttgagatcgttttattgtatttttttttgggcgatagagagagacgttgtttattttcgtttttattaaaataaataaataaataaataaaaaaaattttgagattgggtaatttatagagaaaagagtttgattggtttacgttttgtaggttatatggaaagtataggtgtttttgtttttggagaggttttaggaagtttttaatcgtggtggaaggcgaagcgggagtaggtgttttatatggcgtgagcgggaacgagaaagatagagtaggtgcgggatatagttaaatggttatttataatttcgaggatagtattaggagggacggggttaagttatttacgagaaattcgtttttgttatttagttattttttattaggttttatcgttatattgtagattttatttttatgtgaggtttgggtggggacgtagagtcgtattatattattatttaggaggatgtttaggagtaggcgtgtggggcgtttagggatgatacgttttacggggggattttgtttttaggggttagggtgtttgggaagaggttgggagtcggcgtggttgtggtttttttatttaggtattatagattagggttggtgggttttagggggtgtttatatttattattttgaattttatgtttttttttagggaaacgtgtagaggaaatggttggagagcgaagtttaggtataggggttatgagagtcggattttacgtagttgtagatttcgattcgaattgtatgcggttgaggatttttaagttaggtagatttcgatttagattttacgcggtcgcggattttcgatttcgatttaaattgtatgcggttgaggatttttaagttaggtagacgttaatttagattttacgcggtcgcggattttaatttagatagatttcgatttattcgtgtagtttttagttttagaagttaaattttagcgttttttagggcggttcgggtttttttagatatagtagttttttgaggtggttttatttgtaattttagattaattagagaaggttaaatgggttttttaagtttagtaggtgggattttcgatttagagagtttttttttcgttttaggttaatagttattttcgggtttcgtattaggtttgttaaatgtaggggcgaggggtcgatttcgttacgggaattaaatttaggaaatagtttatttagcgtttatttttattcggattcgtcgtcgcggtcgtaggtttacgcgtcgtttcgcggagattttttaggcgttttcggttcggtagaaattcgcggtttcgatggtagaggttttggtgggaatcgtatcgtttgtcgtttttgttttcgcggaggatgcgttgttttaaattgttttcggttttttattttttaattttcggtagttttcgattttttttcggtcggcgtagtttagtttttcgtagacgcgggggagttggaattcgattacgcgtagtttttttatcgtggtgtacgtttcgggttttttacgttttttttaggttttattatttatttttttttagcgttgaaggaaattttttagatgtttttttatttatttatcgaagtaggtttcggttgtttttagtttcgggttttttcgagaatattgtaagtttttattggttttttttcggtaattttacggtttatttttaatttgtatttattttgtggggtttttattttttggaggaaggacgtgttaaagtttggaggtgcgcggtttgtttaattttcgtttaaggcgcgcggtaggcgataggttttagttcggattagcgtggtttaaaaggatttatcgttaaaagtgttggttttagaatttaaggggaagatatgttggttttttgatgagttgggtcgttttttttaggaagttttttttttggagttttgtagttatcgtgggtttgtaagagttaaagggtttggtttatagcggcgttcggtattgagttggatagtgttttgtttttaaaatttatgttcgtttagaattttagaatgtaattttttttggtagtagggttttgtagatgtaattaaggatttggggacgaggttattttggattgaggttgagttttaagttagttattggtgtttttttatgaagagtagagtagaatagagatagatgtatagagtaggttttgtgaggatagaggtagggattggagcgtcggtcgtagtaggggcg

SEQ ID NO: 112 - DNA, 2470 bp, Artificial Sequence
  chemically treated genomic DNA (Homo sapiens)
aaaattaatcgttattttaaaatgtattgttttgatattttgttgttgaggtaggtggtgatatgtagaaattaattttttttttaaaacgaaaaaataatgtatttattaatatgttttttttaaaattcggggaaaatttttaaatcggagaaaaaaatttaatattagtatttattatataaagtattaaaaatattttttagtagttttgtttaagtattttaggttagtggtagtatgttagttaaaatgtaatttaaaatgaatgaataatagttagttggtagatattgtatgtaatataatacggaaatatattggaagtattttaaaatttaatatttgaattcgtgaatgtttaaattaagtattttaaattaggcgtttatttttgaaataatattttaaaatacgtgttggtggtaagatcgttagttatttgtaggaaatttttttaatggtttaaaatttttaggttttagaaggggcgattgattaggttaaatttatatttttcggtttcgtagttgttagtttaggtagcgaatttaaaatattgggggtggatgagtagtttgaagtttagattaaggagtgaaaaaggttgatgtttagaagcgtcggtttttttttattcgcgtattcgagaggttacggcgtagtaaagtttggttttattagcgggtttggacgttcgcgattaaagttttttaagaaaagtcgatatcgcggtcgggagcgttcggaagtttagtaggatacgtttttattgtagggaggagggtgtttgtggcggttttggcgtggagttttttttttttttttcgtaggattttgtattcggacggggataggtttcgttagttaaggcggcgggagacgcgtaggttataaggaggaaatgggatagagtgcgatagagaggcggcggcggtttagggtcgggtcgagtttttttcgcggggtagcgagagggaaaggggttttttcggtcgtagttttttttatttcgagaggtagttttaattttttttttagcgtacgacgtcgtacgggtcgcgcgagatttcgaaattttgttagttttcgcgtcgttttaggttcgttttagcgttttgcgtcggtcgttaattttcgttttttttagatagttgtttaagtttatttatttcgcgggtcgattagtgtttattttagatcgaggtcgaggcgttcggttcggtcgcggttttatagtaggtttttaggttttagttatttcgttgttaagttttttaatatggattttttcgttcgttttgtggtgttatagggtttttaggatattgatttcgttggttcggttcggaggcggcggcgaagtagggagcgatttaggttgcgttgtttcgcgcggtttaagttatcgttatttttttttttttcgttttgtttagttttttttttttttttttttttttgcgcgttttttttttttttttttttttcgttgtcggcgcgttaaggtgacgacggcggtagtcggattcgttatattttgtttattcgttcgttttggttttgagtgtatgttcgtagtatttagttgggtcgtaggggggcgttggtaaattgttgtttgagatcgagaagcgtggtgggtggagttacgttacgcggtttgtgagcgggaggaagggtagttgcgttggaggggttttttgggaaacgtttttttagtatcgtttttcgtttatattgcggatggtgcgtatgcgtagcgcgtggattttggtttttgtttttttttggtagttttataggttgcgtcgcggaggataatgaaagaggttttaagggaattggataggaaggattttgcgtagggtgtgttttttatttttatggtaatttgatattgaaaagagtgttcgtatgtttgcggtggattgagtgtttatttggttgcgttgtttatttgaaatgtagtttgtggagtgaagagtcggtaatttggaagtttatttttttttttttttggtgggtatttttttagatgttagggggagagttttttcgtttgatttttcgagtttaggggtttttttatgttttaattttatattataaaattaaatttgggttaggtgcgcggtggtttacgtcggtaattttagcgttttgggaggtcgaggttggcggatcgtttgagtttagtagttcgagattagtttgagcgacgtattaagatttcgtttttataaaaaataaaattaatcggtcgtggtggcgcgtatttgcggttttagtttttcgggaagatgaggtgggagaatcgtttgaattcgggaggcggaggttgtagtgagtcgagatcgttttattgtattttagtttgggcgatagagcgagattttgttttaaataataataaaaattttattattatttatttaaaaggttttcgcgttgtggttagatagtgacg

SEQ ID NO: 113 - DNA, 2470 bp, Artificial Sequence
  chemically treated genomic DNA (Homo sapiens)
cgttattatttaattataacgcggaggttttttaagtaaataatgataaagtttttgttgttgtttgagatagggtttcgttttgtcgtttaggttggagtgtagtggaacgatttcggtttattgtaattttcgtttttcgggtttaagcgatttttttattttattttttcgaggagttgggatcgtaggtgcgcgttattacggtcggttaattttattttttgtagaaacgagattttaatacgtcgtttaagttggtttcgaattgttgagtttaagcgattcgttagtttcggttttttaaagcgttgggattatcggcgtgagttatcgcgtatttggtttaaatttaattttgtgatgtggggttaagatatgggaaagtttttaggttcggggagttaggcgggaaagttttttttttggtatttaaaaaaatgtttattagaaaggaggaaaggtgggtttttaaattgtcgattttttattttataggttgtattttaggtgggtagcgtagttaggtgaatatttaatttatcgtaaatatgcggatattttttttaatattagattattataaagataaggagtatattttgcgtaaaattttttttgtttagtttttttaaagttttttttattgtttttcgcgacgtagtttgtaaaattgttaaaggagggtagaggttaaagtttacgcgttgcgtatgcgtattattcgtagtgtgggcgaagggcggtgttggaaggacgttttttagaaggtttttttagcgtagttgttttttttttcgtttataggtcgcgtgacgtgattttatttattacgtttttcggttttaaatagtagtttgttagcgtttttttgcggtttaattgggtattacgaatatgtatttagggttagagcgagcgagtaagtagaatgtggcgagttcggttgtcgtcgtcgttattttagcgcgtcgatagcgagggaagggaggaggagggagacgcgtagggaggggaggggagggaggaggttagataaggcgggggaagggggagtagcggtggtttaagtcgcgcggagtagcgtaatttgggtcgttttttgtttcgtcgtcgttttcggatcgagttagcggagttagtgttttagagattttgtaatattataaagcggacgaaggagtttatgttggggaatttggtagcggagtgattgggatttgggaatttattgtggggtcgcggtcggatcgagcgtttcgatttcggtttgaggtaaatattggtcgattcgcggggtggatgggtttgggtagttgtttgggagagacgagggttagcggtcggcgtagagcgttggagcgggtttagggcgacgcgagggttgataaagtttcggaatttcgcgcggttcgtgcgacgtcgtgcgttgggaggaaagttggagttatttttcgaagtgggggaggttgcggtcgggagggtttttttttttttcgttgtttcgcgagggaggttcggttcggttttgggtcgtcgtcgtttttttgtcgtattttgttttattttttttttgtggtttacgcgtttttcgtcgttttagttggcgaagtttgttttcgttcgggtgtagggttttacgggggggggggaaggggttttacgttagaatcgttatagatatttttttttttgtagtggaaacgtgttttgttgagttttcgggcgttttcgatcgcggtgtcggttttttttgggagattttggtcgcgagcgtttaagttcgttagtgaaattaaattttattacgtcgtgatttttcgagtgcgcgaatggggaagagtcggcgtttttaagtattagttttttttattttttgatttgaattttaaattatttatttatttttagtgttttaaattcgttatttgggttgataattacggggtcgggagatataaatttagtttaattagtcgttttttttgagatttaggaattttgaattattaaaaagattttttatagatggttggcggttttgttattaatacgtattttgaagtattgttttaaaagtagacgtttgatttagagtatttgatttagatatttacggatttaaatgttgaattttgaaatatttttaatatattttcgtattgtattatatatagtgtttattagttgattgttgtttatttattttggattatattttggttaatatgttattattgatttaagatatttaagtaaaattgttgaaaaatgtttttaatgttttgtgtagtagatgttgatgttaaattttttttttcgatttgggaatttttttcgaattttgggaaaagtatattaataaatgtattattttttcgttttaaaagaaaaattaatttttatatattattatttattttagtagtagaatattagggtagtatattttaaaataacggttggtttt

SEQ ID NO: 114 - DNA, 2305 bp, Artificial Sequence
  chemically treated genomic DNA (Homo sapiens)
ttgagaaattgttatagttataagaggtatataaggagatattataattaaatgtaatgtggtattttggatggaattttggaatagaaaaagggtattaggtaaaatcgaaggaaatttgaataaaatgtgaattttagttaataatagtgtaaaatattggtttattaattgtaataaatgtattatattagtatgagatgttaataataggggaaattggatgttgggtatatggtattattttaatttaaataaattatattaagaaaataatatttatttttaaaggtgtagtgaataaaataatggttatttatatatttaatattcggtttaataatggttaatatagttaaagtttttttttattgttttttttttattagatatgattgttttttttaatttgatttttatttttttgtattttttgatttttttaattatatatgtatgtataattaagtaatatatagtattgttttataagttttagagttgaatgtatatgaattgttatattatttatttttttatatttttttttttttgttttattatatttttgagtttagtttttttttattggcgtataatattatattttaatattttataaggtatttattttgttattgatggacgtttttaattttttgtttttatttatagcgttgttacgtatatttttgtttatttattaaagtttttataagatatataggtaggagtagagtgttggggtttagtaattgaaaatttttattagattttgttatattgtttttttaaagaggttttaatatttgcgtatttattagtaggtgcgtatgtttagacgtgtggaggagaaattatttaaagatatataaattagataatatatttgttttattttcgtttgattttcgtatttaagtaattatttttgtaaataaataaataaataattattaatagtatttttcgtatcgttagtcgtagttttttttgcggagacgcggatataaggtagttttcggcgaaggcggtgacgtaaaggatggcgtaagtacgttcgggacgacggcgtttttttgatcgtttttgaaggttttttttcgggttgtttgatacgatgtaagtgttagtttgtgttggtcggttgtttttttttcgtaagaggggaaaatatttttatagattttttgtgtttttagagacgatttttttttttagaaagaagtcgtttacggttggcgttttttttaggtagcgtcgtgggtagtttataggtttttgtaaggcgcgcgtcgcggtttcgttttttttttttcggtcggaatcgttattttttaggtagggtttacgcgtggttttcgggcgttaggtgttcgatagatttgaatcgcgattttgtggttttagaggtcgtttattgggatcgtggggagattttttaatttgtttgaggtttattggtatgggcgggttaaattatgttttgttagacggggagtagcgtgcgtcgggtcgggtttgggtcgtgggttgagaatcggattgcgatgttgcggttttgcggggggatatttgcgagaaagacgagattgagtcgtttggggtgaggcgattcgagttaatttttaaaagatttcgttttatgttttcgtggttgtattttcggtattgtgggtggttttttttatataggttgtgtgggggtcgcgtggtttgatgtttttttaattttttttagtgtggtttttttattttaaattttgcgatgatgttgggtgaggatttaaggggtagtaggaatgggtttaaagttaggcgtcggttttaattttttgtgaagtttataggtgtgaaaattcgggttttcggtcggagagtgggtttcggagtcgttttgggtgatgaatttttattgtttttagttaatgtataagacgattttcgattgtttttaaaattttgattttatatggtgatcggacgaagggaaagtgttttgaggttgtaatattaatatttgtattaagaggagatattgttttgcgaattttagggtagtatgttttgagtgaagggaaatatttagttatagtttattattttgtttagtttgtggacgttaatagagtcgagtaaattgtaggttgttttttatggtggattttagttgttatgattttaatatttttataaattgtaaagtatcgttttgaaaagtgtttttagttttaagtgtatggggtttatgtttaaaatggattttaaatttagaaagatggatttagtggaggattatgggttt

SEQ ID NO: 115 - DNA, 2305 bp, Artificial Sequence
  chemically treated genomic DNA (Homo sapiens)
gagtttataattttttattagatttatttttttgagtttggaatttattttaagtatggattttatatatttaaaattgaaggtattttttaaaacgatgttttatagtttgtaagagtattaaaattatggtaattaggatttattataaagagtaatttgtagtttgttcgattttgttgacgtttataaattagataaaatgatgaattatggttaaatgtttttttttatttaaagtatgttgttttagaattcgtaaaatagtatttttttttggtgtaaatattggtgttgtaattttaaaatatttttttttcgttcgattattatgtggggttaaaattttaaaaatagtcggaaatcgttttatgtattaattaagggtagtgagggtttattatttaggacgatttcgggatttatttttcgatcgagagttcgggtttttatatttgtaggttttatagaagattaaagtcgacgtttgattttaaatttatttttattattttttaagtttttatttaatattatcgtaagatttggaataaaaaagttatattgaaaggagttagaaaggtattaggttacgcggtttttatatagtttatgtgagaggggttatttatagtatcggagatgtagttacgggaatataaaacgaagttttttaaagattaattcgagtcgttttattttaagcgatttagtttcgtttttttcgtaaatgttttttcgtagggtcgtaatatcgtagttcggtttttagtttacggtttagattcgattcggcgtacgttgtttttcgtttggtagaatatggtttaattcgtttatgttaatggattttaaataggttagagagtttttttacggttttaatgaacgatttttgaggttataaggtcgcggtttaagtttgtcgaatatttagcgttcgggagttacgcgtaggttttatttggaagatggcggtttcggtcgaaaggaaagaggcggggtcgcggcgcgcgttttataagggtttgtgggttgtttacggcgttgtttgagggaaacgttaatcgtaagcgatttttttttagggaagaagatcgtttttgagaatatagaaagtttgtgaggatattttttttttttgcgaaagaaaggtaatcggttaatataagttgatatttgtatcgtgttagatagttcggaaaggggtttttaagggcgattaagaggacgtcgtcgtttcgagcgtgtttacgttattttttgcgttatcgttttcgtcggaagttgttttgtattcgcgttttcgtagggaaaattgcggttggcggtgcgggaagtgttattagtagttgtttatttgtttgtttgtagaaataattgtttgggtacgaaggttaaacgagaatgaagtaagtatattatttagtttgtatgtttttaaatagttttttttttatacgtttaaatatacgtatttgttagtaggtgcgtaaatgttaaaatttttttgggaaagtaatgtggtaaaatttagtaaaagtttttaattattaaattttagtattttgtttttatttatatgttttgtagaaattttggtaagtgaataaggatgtacgtaatagcgttgtgggtagaagtaaaaaattagaaacgtttattaataatagaataaatattttatgggatgttaggatgtagtattatacgttaataaaagaagattgaatttagaaatgtgatgaggtaaaaagagaaagatgtagaaaaataaatagtatgataatttatatatatttaattttaaaatttgtaaaataatgttatatattgtttagttatgtatatatatgtagttaaagaagttaagaaatataagagaatgaaaattaagttgagaaaagtagttatatttggtaaggaggggataataaagggaggttttaattgtattgattattattaaatcgggtgttaaatatatgggtggttattgttttatttattatatttttaaaaatagatattatttttttaatgtagtttatttaaattgagataatgttatatatttagtatttagttttttttattattaatattttatgttaatatggtatatttgttgtaattaatgaattaatattttatattgttattaattaaggtttatattttatttagatttttttcggttttatttaatattttttttttgttttaggattttatttagaatattatattatatttagttatgatgtttttttatatgttttttgtggttgtggtagttttttaa

SEQ ID NO: 116 - DNA, 2234 bp, Artificial Sequence
  chemically treated genomic DNA (Homo sapiens)
ttatttgttattttgtttgttttgtttgtatggtaggttagtttttgtttttagagtggagattcgaagtatttaaaaagtttatttatttttttttttttttttttagttagagaagagtgattgttttattttttgtttttgtttttatattttcggatatttagggagtttggtggcggggaggtgtgtttttaggcgttttgtttttagtttttttgcggggtttgtattagatttggaaaaaataggttttagggtggggaggggtaggatttgaggtggtcgtggttgggagtttgagttagtgtggattgtgttaatgtttttgtagtagtttggtttgttattttttgagagttatatagcgggtaggagttatttttattcgagtttttttttttttttattttgttataagatagaattgtattatatatttttaaaacgagtaaaatggtattttagttttttgtttttatagattttttgaattttaggaaagattattttggtttttttttattaataatgaaaattagggggtaataaaatgtttttaacgtgagtatggtaggaatgaggagcggtgaggggtgaagggtgaggttgtagggattataggtgttttttggggttggaatagtttagaattttggaaagtgaggtagttattgggagggttttggtttttaatttatatagttagcgtttgtttagttttgatagtttagagggttttagagaaggttgttttttttatggcgggatgtttgcgggtgagtagaggaatttagtaaattttaggtgttggttaagtttttagttaagttatagttgtttttttgtaagaggttttatggtgtttgagaaattagtggtgaatatggtattcgggtcgtgggtttcgttttgtatttgttttgtttgaggattttggttgtagggagggatgtttcgggtatggatgaaggtttttttgagtagggattttgagagagcggggtggttaggttgttttgtttttattttttttttttgaaaatggatttgtattagatgttaggttttgtatttggagcgttaagtaaagttggttagaagaggggagatagaagagatatttgattaggattttaagtgttcggttttttggggtcgaggtgaaagattcgtttgttttagtgtttttagagttttttgtataacgagaggtgatttgtgtcgggtgggggtgtttattattagtgaagtagtattgttttttttttatggtagttttttagatatcgagtgttattgtatagtttgggaagggagtgggggaagtttttgttaattataatataaattttagaatttataaaagaatagattgataaatttgtataaaaatttttgtatgcgataaaatattattagtagagttaaaagaaaaataaattagagaagatgtttgcgatgtagattatagatagcgggttaatatttttgttatataaaaagtttttttaaagtgataagggaaaagaaattaagtagaaaagtggagagtatatagtatatcgaaaaggaaatgttgatgaaaatatgtttaatttttatttaaaatgagattaatgtaaattagaattagagtgaatttttgtttttttgttgtggtattggtaggaatttttgcgtttgaatcgtgtattgtgtgggcgtagtcgtggggaagtaggtattgcgtagcggtttagggtgaattatcggttttatggaggtagggtggtagtattttttaaaattgtaaatgtatacgttttgggattattttttgggggttttgaggtttatagggtgcgtgtttttatgtgggagatggtacgtgtgtacgttgttgatggtagcgtggtgtgtagtagtagaaagttggaaatgagttgggtgtttatcggagggtaggtgaagtggaatattttgtagttgtagaaaataagattgagagatggggaaacgtgaaggaagagaagatattttgtgttattttaggtgtgtatatagatttattggaaggataaatgtaagattattaatggttgttggtggtggggaagtttttttttatagattgttttgtgttattcgatgagtaaattgtatgcgtgttatttgtttaaaaagtgtaaaatagaaatgggagttggggattgagggagaggttttatgttgattatagttttgggatcgag

SEQ ID NO: 117 - DNA, 2234 bp, Artificial Sequence
  chemically treated genomic DNA (Homo sapiens)
ttcggttttaaaattgtaattaatatagggttttttttttagtttttaatttttatttttgttttatattttttgaataggtagtacgtatatagtttatttatcgaatagtatagggtagtttgtgaaaaaaggtttttttattattaatagttattagtagttttatatttatttttttagtgagtttgtgtgtatatttaaggtggtataggatgttttttttttttttacgtttttttattttttaattttgttttttatagttgtaggatattttattttatttgtttttcgatgggtatttagtttatttttaattttttattattgtatattacgttgttattaataacgtgtatacgtgttattttttatatggggatacgtattttgtgagttttagaatttttagagggtggttttagggcgtgtgtatttgtagttttgagaaatattgttattttgtttttatggggtcgataatttattttgagtcgttgcgtaatgtttgtttttttacggttgcgtttatataatgtacgatttaaacgtagagatttttgttaatattatagtaggaaaatagaagtttattttagttttaatttgtattgattttattttgagtgaggattgagtatgtttttattagtatttttttttcggtgtattgtatgttttttatttttttatttgatttttttttttttgttattttagagagattttttatatagtagggatattagttcgttgtttgtgatttgtatcgtaaatattttttttggtttattttttttttgattttgttaatggtgttttgtcgtatgtagaggtttttatataaatttattaatttatttttttatgggttttggggtttgtgttatggttagtaaggattttttttattttttttttaggttgtgtagtgatattcggtgtttaagaaattgttatgggaaggggatagtgttattttattgatggtggatatttttattcgatataaattatttttcgttatatagggagttttaagagtattgaggtagacggattttttatttcgattttaaggagtcgggtatttggagttttggttaggtgttttttttgtttttttttttttagttagttttgtttggcgttttagatataaaatttgatatttagtgtaagtttatttttaggaggaaaaagtgaagatagagtaatttggttatttcgtttttttagagtttttgtttaggagggtttttatttatattcggaatatttttttttgtagttaaaatttttaggtagaataagtgtagaacggggtttacggttcgaatattatatttattattgattttttagatattatgaagttttttgtaagaaagtagttgtgatttggttgaaagtttgattagtatttggagtttgttggatttttttgtttattcgtaaatatttcgttatgagaaggatagttttttttggggttttttgggttgttaaggttgagtagacgttggttgtgtgggttgaggattaggatttttttaatagttgttttattttttagagttttgagttattttagttttaagaaatatttgtggtttttgtagttttattttttattttttatcgttttttatttttgttatgtttacgttaagaatattttattgttttttggtttttattattaatgaaaagggattagaatgattttttttaaagtttagagagtttataaagataagaagttgaaatgttattttattcgttttggagatgtgtgatataattttgttttgtggtaaaatgaaaaaagagaaaaattcggatagagatgatttttattcgttgtgtggtttttagagggtaatagattaggttattgtaaaaatattagtatagtttatattagtttaaatttttagttacgattattttaagttttgtttttttttattttggggtttattttttttaagtttggtgtagatttcgtaagggaattgagagtagggcgtttgggaatatattttttcgttattaggttttttgaatgttcggaggtataaagataagggtaggagatggggtagttatttttttttagttgggaagaaaaggaagagaatgagtgggttttttaaatgtttcgagtttttattttggaagtagggattggtttgttatgtagataaggtagataaggtagtaagtgg

SEQ ID NO: 118 - DNA, 2317 bp, Artificial Sequence
  chemically treated genomic DNA (Homo sapiens)
ttatttggttttttgttttggggtttttaaggagtaagggaaagttgtggttttcggtttgtgtttggttggtggttttatatttttttatttgaggttgattttttatttgaggttgatttgttatttgaggtgggaaggggtatttggagtttttagttgtagggtgagagatatttagtggttttattttttagtttttagagttataggttaggagcggagggttaaggttggcgaaaaaatttggttatgtggacgggttaaagattaggggtcgttgcgaaggtgaggatagaaaagcgttgtagaggtttttagattatggtttcgttttcgttagagagttttaggggttttagtggtttttttagtgttgtgtatatacgaggaaaggttagagaatgagagggatatagtatttttttattttttaagtttgtacggggagaagcggttgtgagttttagtattagggaaacgtagcgttggggtttgggtaggattgatcgttttagtttttattttagttgtaattttttagtcgaatagggttcgtttcggcgggttagggttttcgtttttgttgaagaattttggtttaggaaagatggagaggttgggggttgaggagagaggaaaaaatggtaggggaggattggaggtgatcgagcgtcgagtttttatatttttattattgttgttgttgttgttattattattattattattattattattattattattattatcgaagtattttacgtttagagttaagataagattataaatataatatatagaaaattaataaaatagaattttgtttttttttgaggtttttttttttatttttaggtagtatgtgttttttttagtggttttggggagggggtgggagagacgataggtttgggattagggagtttttaaggttttcgttgaggggatagcgaatttattattgaatcgtgtacgggggatatggataaaatgagacgcgatagggataagagtattttgttttgtttttaggaaatattaagtgagttcgttttttagtttttattaggaagtttgattaggttgaggcgagtttttcgggaaggaagggcgcgcgggatgttgggtgggttcgagtagtgaggttttagagtattcgtcgggagttgtgcgggcgggggcgtttaggagagcgttgggtttcgtttgtttgcgtcggagagtaggttttttggtttttttattcgagagttttttttttcgggtttttttgacgttttcggttttttataggttttttttttcgcgttttttttttttttttagtatttttattcggtttgtttttttttttttttttcggtattgagttgagacgcgttgagtagtttgtttttttttttttattttatgcgtcggttttggaattatattttgatttgttttttcgttaggtatagggcgtgcgcgatttcgatgcgtcgtcgtcgcgttaggtagcgattgtagtgaaattttttttttagttttagcgtttggtaacgtgtgtatgtttggcggtttcgtcggtcgttgggtttaaaggaggaatttgttacgtagagtggagatgttgaggtttgcggttatcgggtttaggatttttttttttagtcgattttcgaatatagattttagttagtatcgggatgttttttattttgtcggtttttttttttcgtttcgtatttttttagcgttttttttagatttttttttagttttttaggtttgtgtcgtttgtttagattttagatgggggaggggaggagtagtttgaatttttatttgagtttggggggaggggttggttaggtgtgtttttttttagttgtattttgtttttttttttttttttatttattttgtttttatttttcgttatttttttaatttaatgataaatttaggtcgttaattcgtaatgacgtagatcgatttatagtttatattaacggttttttattttcgagttcggttaatggatattagttgggatttaaggttaataaataatttaatttgagatttcgcgtttgtttttttttttttcgtttcgtttgtttttttttttttttttttttttatttttttttttttttttgattattattttttttttggtgttttattttgttttagttttttatttatagggaaatatagttttagatagatttaattttttttttttagcgttattttttatttttttgtatgacgtatttcgtttttaatggagtcgtttttggttggggaattttattagggt

SEQ ID NO: 119 - DNA, 2317 bp, Artificial Sequence
  chemically treated genomic DNA (Homo sapiens)
gttttggtagggttttttaattaaagacggttttattaaaaacggagtgcgttatgtaagggggtagggggtgacgttgaagagaaagagttgagtttgtttgggattgtgtttttttgtgggtggggagttggggtaagatgaggtattaggaaaggggtggtagttagaggagggaggaggaataaggggaaggaagagagagggagtaggcggagcgagagagggagaaataggcgcggggttttaggttggattatttgttggttttaagttttaattgatgtttattagtcggattcgaaagtgaggagtcgttaatgtggattatggatcgatttacgttattacggattaacggtttggatttattattgggttggggggatgacggggggtgggaataagatggatggaaagggagggaaagataagatgtaattaggaagagatatatttgattagtttttttttttaggtttaggtgggagtttaaattgtttttttttttttttatttagagtttagatagacggtataggtttaggagattaggagggaatttggagggggcgttggaggagtgcgaaacgggggaagggagtcggtagaatagagggtatttcggtattggttggagtttgtgttcgagggtcgattaggggagggggttttgggttcggtgatcgtaggttttagtatttttattttgcgtaataggttttttttttgggtttagcggtcggcgaggtcgttagatatatatacgttattagacgttggagttggagaaggagttttattataatcgttatttgacgcggcggcggcgtatcgagatcgcgtacgttttgtgtttgacggagaggtagattaagatatggttttagaatcgacgtatgaagtggaaaaaggagagtaaattgtttagcgcgttttagtttagtgtcgaggaggaggaagaaaaataggtcgagtgaaggtgttggaaagggagggaggacgcgaggggaaaggtttgtggggagtcgagggcgttagagagattcgggaaggaaggttttcgggtgggggagttaggagatttgtttttcggcgtagataggcggggtttagcgtttttttggacgttttcgttcgtatagttttcggcgggtgttttgaggttttattattcgagtttatttagtatttcgcgcgtttttttttttcgaggaattcgttttagtttgattaggttttttggtgagaattgaggagcggatttatttgatgttttttggaagtagagtaaaatgtttttgtttttgtcgcgttttattttgtttatgtttttcgtgtacggtttaatggtagattcgttgtttttttagcgggggttttgaagattttttgattttagatttgtcgttttttttattttttttttaaagttattggaaggagtatatattatttagaagtaagaagaggagttttagaagaaaataaagttttattttattaattttttatgtgttgtgtttgtagttttgttttagttttggacgtgaaatatttcgatgatgatgatgatgatgatgatgataataataataataataataataataataataataataaagatgtgaaaattcgacgttcggttatttttaatttttttttgttatttttttttttttttttaatttttagtttttttattttttttgagttagaattttttagtaaaggcgagagttttggttcgtcgaagcgagttttgttcgattgggaagttatagttgagataaaggttggagcgattagttttgtttaggttttagcgttgcgtttttttggtgttgaggtttatagtcgttttttttcgtgtagatttgggggatggagaggtgttgtgttttttttattttttagttttttttcgtgtatatatagtattaagggagttattgaggtttttaaagttttttggcggagacggagttatagtttgggggtttttgtagcgtttttttgtttttattttcgtagcgatttttggtttttggttcgtttatatggttaggttttttcgttagttttggtttttcgtttttggtttgtggttttggagattgaaaaatggggttattgggtattttttattttgtagttgaaggttttaggtgtttttttttattttaagtagtagattagttttaagtaggagattagttttaagtaggggaatgtaaagttattagttaggtataggtcgaaggttataatttttttttgttttttggagattttagggtaggaggttaggtga

SEQ ID NO: 120 - DNA, 2553 bp, Artificial Sequence
  chemically treated genomic DNA (Homo sapiens)
ttggttatttttgtttttttttagatttttagagtttttagtgtagttatagaggatgttgttggttttagttttaagaagacgtcgttttttttagagggttaagtaagtgggaatttttttttttatttgttttgggttttaggtagggtttttggtgtaaggtttggggttggaagtcgatttatttaggtttaggttttggggtagaattgaaattttttggttattgtcggttgtagtttgggagtaggttattgttaaagttgtgggtttttttaggatagtttttttatgaggtcggttttttatttgttgtttttttatatttggtggttagggatgtggttttgggtagaacgatgattttttatttttgttattatggaagttatcgttgttttttagtttagttagttatttgggttgtagagtattttttttatgtttttcgggtgtttttttttttttttgttttagtttggttttgttttattttgtttttagggaggggtattttggagtggggttagggtatggttttttttcgagggagtttttttttggttgtttttagggtagttttgtatagttttagtatttggcgtattttttttgatattttttttagggatagttaggtattttgtgtggggtatttaagagagttaggttcgttagtttttagtttttgttagaatgtaggtttgaggggtgaggggcggggtaggggtagggataggaatttcggcgtgttttttattcgtaaaggtttattgaggtttcgagttttagttattgagttattaagttagtttgggttaggtttgggtgttttgtttgtaatggaggtagagacggggtttcggggtagttttgaggatgttgggtgtatagcgggggtttcgtcggtaggaattatttatgtttttttttgggttaagttttgtggatgtttagtttggggtcgcggggagttggtaggttagtggtagatattggtgggtagatttagtgtttggtagaataggtattaaggaagtggtgatcggagggaagttaagtgtatttaaattttcgggtgagttattatcgtcgggttttttatagttgttgaaagtgagtaatagtgatgaaggtttgtgagtttttgcgtgagcgagtgaatggattagtagtagtttttaggttgtggaagagcgtttttttttcgggatggggatatttggttatagtaatttttaattttttatttatttatcgtttattgtagaggtatgcgggggttttgttttttgtaggtaggagtgaggggtatttttgtgatgtggtatttttgtgatcgaggttatgtgtgatcggtgtaagggtaggaagcgagttattggtttgtattaggcgtgggggtttttgcgagggtaggatttaaagtcggtttggtttttcggttgtagtatttttttttttttcgaattaggttagagttttgggacgggaggtgttttgtagattattttttttattaattttcgtttttcgttttattttcgcggtgattcggtgaattgtcggttttttgttgtgtatcgagtggggtagtgattttgacgtggcgttttttgtcgtttttgttatcgttattattttcggtggtttagttttcgtattttttatttttatggaggaatgtattaggtttttttttttggatgtattttttatttatatgtttttaaattttggtattttttgttttttttttatttttatttttttttttaggtttttagataaaggggaagtggttggatttttttaaagggatagtgttttattagtttattgttgaatttttttttttaattttagttttttagttatagttaattagtattagtagatagtttatgagtgatatttatgtaggttttaggttgtggagagttttttgggtaggaaatagtttttaaggttttttattttatttaggttttagttttttttatttgttttttttttagattgtggttttttggagtttggtttttttgtttttgtgtgatcgatatatagtatttaaatagtggtagagcgggacggattttttagtttgttttttgtgtgggtttgtattttgatttagatatgtttttttatagtaggatttaggggggtatatgtgtgtttgcgggtttattggggtattcgtatttggtttattttattttttagagagagggttttgttgtgttatttagttggagtgtagtggtgtaattatagtatattgtagtttttaatttttgggtttaagcgattttttttttttagtttttttagtagttgggagtataggatttattgtattttggttaattttttaataattttttaagagatggggttttattgtgttgtttaggttggttttaaatttttggttttaagtgatttttttattttcgttttttgaagtgttgagattataggtatgagttattatgtttattttagattgatatttttatatttgtttattttggttgggtaggg

SEQ ID NO: 121 - DNA, 2553 bp, Artificial Sequence
  chemically treated genomic DNA (Homo sapiens)
ttttgtttagttaggatgaataaatatagaaatgttagtttgggatgggtatggtggtttatgtttgtaattttagtattttaggaggcgaaggtgggaggattatttgaggttagaggtttgaggttagtttgggtaatatagtaagattttattttttaaaaaattattaaaaaattagttaggatatagtgggttttgtatttttagttattagggaggttggggagggaggatcgtttgagtttaggagttgaaggttgtagtgtgttatgattatattattgtattttagttgggtgatatagtaagattttttttttaaaaaataaaataaattaaatgcgggtgttttagtgaattcgtaggtatatatgtgtttttttgggttttgttgtgggggggtatgtttgggttagggtatagatttatatagagaataggttagggggttcgtttcgttttgttattgtttgggtgttatgtgtcggttatatagggatagaagaattaggttttaaagggttataatttaggagagaggtaggtaggaaagattgggatttggatgagatgagggattttaagggttgttttttatttaggaaattttttatagtttggggtttgtatgggtattatttatgggttgtttgttaatgttaattaattgtaattagggaattggggttgaggaggggagtttagtagtaagttggtgggatattgtttttttaagaggatttagttattttttttttgtttgggagtttaggggaaggggtgggagtaaagggggagtagaaaatgttagggtttggaagtatgtgggtgaggggtgtatttaggaagggaggtttggtgtatttttttatgggggtggggaatgcggaggttgggttatcggaggtggtggcggtggtaggggcggtaggagacgttacgttagggttattgttttattcggtgtatagtagggggtcggtagtttatcggattatcgcgggggtggggcggaggacggaagttggtgaggggggtggtttatagggtatttttcgttttagggttttaatttaattcgaaagggaaaggagtgttgtagtcgggaggttaggtcgattttgggttttgttttcgtagaagtttttacgtttggtgtagattaatgattcgttttttgtttttatatcgattatatatgatttcggttataggggtgttatattataggagtgttttttatttttgtttgtaggaagtagggttttcgtatatttttgtagtgggcggtgggtgggtgggggattaggaattgttgtaattaagtgtttttatttcggggagggaacgtttttttataatttggaaattgttattggtttatttattcgtttacgtagaaatttataaatttttattattgttgtttatttttagtagttgtgaaagattcggcggtgatgatttattcgagggtttgagtgtatttggttttttttcggttattatttttttgatgtttgttttattagatattaggtttgtttattagtgtttgttattgatttgttagtttttcgcggttttaggttgggtatttataaagtttggtttaggagagagtataagtgatttttgtcggcgaggttttcgttgtgtatttagtatttttagaattgtttcgagatttcgtttttgtttttattgtagatagggtatttaggtttggtttaggttgatttggtggtttagtggttggggttcggggttttagtgaatttttgcggatggagagtacgtcggagtttttgtttttgtttttgtttcgttttttattttttaggtttgtattttggtaggagttagaggttgacgggtttggtttttttgagtgttttatatagagtgtttgattgtttttaagaaggatgttaagggaggtgcgttaggtattgaggttgtgtagagttgttttggggatagttagagaggaattttttcgggggagagttatgttttggttttattttagggtatttttttttgagagtagggtaggataaagttaggttggggtaggagaagggggaggtattcggagggtatgaaaggggtgttttgtagtttaggtggttggttgggttgggagatagcggtggtttttataatgataggagtggagaattatcgttttatttagggttatatttttggttattaggtgtgaagaaatagtaggtggaggatcggttttatggggagattgttttggaaggatttatagttttggtagtggtttgtttttaggttgtagtcgatagtaattaaggagttttagttttgttttagagtttggatttaggtgggtcggtttttagttttaggttttatattaggggttttgtttggagtttaggataagtagggagggggatttttatttatttagttttttggaggaagcggcgtttttttggggttgaagttaatagtattttttgtggttatattgggggttttggaggtttaagggagggtaggggtggttag

SEQ ID NO: 122 - DNA, 2381 bp, Artificial Sequence
  chemically treated genomic DNA (Homo sapiens)
gcgaaatagttaggtcgttgtttttaggacgcggtgggcgtacgttttgcggggttcggcgagcggaggcgcgggggttggggcgtgcgtcggcggcggtcggttcgacgcggattttttgggttcggggtggggacgcgggggcgtttacgttaacgttagtcggtttcgtttatttggcgttcgtttcgttcgcgcggttcgtcggttgcgtatcgaatttagataggcgtcggttaagggcgtaggcgttcgcgtcgggttttagttatgttagcggcgacgcgtttcggcgcgtcgttaggatggtcgagcggtttaaggcgttgcgtttaggtcgtagttttttttggaggcgtgggttcgaattttatttttgataagtcgattttttggttcgttcgtcggagggtaacgtttatggtaattttggagtatttttggtcgttttttgttttgagtttttgttcgttttttagattttagtttttttgaagtaagtttttaaaacgtcgtcgttttttaggtacgttcgttttttttgtttattcgtcggttgtcgtagaaatagtttaggattatgcgttagcgttcgcgattttttattaattgtttttcggatagacgttttttttattattttatacgtttttttttttggttttatatatagcgagcgatcgcgattattttttacgtttttttttgtttatttttttcgttcgttttttttttattcgtttaaatagatatagtttagattttttttttatttttttttttttttttttttttttatcggttttcgtttatcgtttatcgttttgaatcgtcgttgcgttgtttagaggcgttttggtttgaatagttcgttcggttttattttttaatttttgatcgttgagtagtagcgagcgattcgttcgtggagtcgtatatacgttttttattagaggtacgttatttaatattttgttttttttttcgatttttcggatttcggtcgcgtattttattttgtcgatattttagttaggtcgtcgattttatttcgttatttgtgtttttttttcgttaatatttgtttgtcggtttatttgtagttcggacgtttgtcggttagaggtagcgggaattttgtatatagtttggtaggcgagtttaaattcggaaagatagtttaagaggaattacgagcggaagttttagattttcgttattcgtttataaacgtttggtttcgtcgggattagttttgcgttatagcgtatttttacgcgggaagtcgcggtttgggtcgttttagtaatatttagcgcgttttttttagggttagttagttgcggttttgtttaagcgttttttcgtttttttttcgcgttttagtttttttattagtttagggggtcggattttaagtgcgagtcggtggcgtgggttagagcgtaggagcgaggcgtttacggatttggtttgcgtttttgagtcgtacgttacggttgcgagattcgttttttatcgtcgttttcgttcgttgatatatttatttcgttttttatttgttggtgatataagtgagaaggttggttttacggtggtgaaaaaaaaaaaatattttacgaaagaaagaaagaaagaaagaaagaaagaaagaaagaaagaaagaaagaaaggaagaaagaaagaaagaaataataaaaataaaatataaaaattttgggtttgtgtcggggattcgcgtttagtaaggttcgttatagtaaatttgtttatacgggtattcgggcgcgggttacggtcggttttttttttggagatttcggcgggtagtttttcgattttgggcggtagagaaagcgtaagatgggacgagtcggttttttttttttcgtttttttttcgcgtttcgttttaggtttttcgacgtgacgagagtttttttttttgttcgttttatcgggttagtttttcgtggacgttgtaataggacggaggtttacggtaggcggtgattagtgaacggcggttggtggcgagtttcgttgtgttagttttcgttggcgtttgttatcggtgtatgggtggtttagtggtagaattttcgtttgttacgcgggaggttcgggttcgattttcggtttatgtagtacgtttttttattttggtgttgtagtagtattaaggcgtagttgcgttcgtttttgtcgtttttttatattcggggcgcgcgagcgagttcggtatcggttgcgtttttacgcgcgacggttttttgttttttttttcgtgtttttttcgattgatttagggatgagtttatttttcgtatttatatattttggtgataataatttttttagatacgagagcgcgttagatat

SEQ ID NO: 123 - DNA, 2381 bp, Artificial Sequence
  chemically treated genomic DNA (Homo sapiens)
gtgtttggcgcgttttcgtgtttggaggggttgttgttattaaggtgtgtgggtgcggggggtaggtttatttttaagttagtcgagagaggtacggaagaaagggtagagggtcgtcgcgcgtgggagcgtagtcggtgtcggattcgttcgcgcgtttcgagtgtaaggaggcggtagaggcgagcgtagttacgttttggtgttgttgtagtattaaaatgggagggcgtgttgtatgggtcgggaatcgaattcgggtttttcgcgtggtaggcgagaattttattattgaattatttatgtatcgatggtaaacgttaacggaagttggtatagcggaattcgttattagtcgtcgtttattggttatcgtttgtcgtgggttttcgttttattgtagcgtttacgagaggttggttcgatggggcgagtagaaggggaggttttcgttacgtcgagggatttgaggcggggcgcggagggagagcggagggagagaggtcgattcgttttattttgcgttttttttgtcgtttagggtcgagagattgttcgtcggggtttttaggggaaggatcggtcgtggttcgcgttcgaatgttcgtgtgggtagatttgttgtggcgggttttgttgagcgcggattttcggtatagatttagagtttttgtgttttgtttttgttgtttttttttttttttttttttttttttttttttttttttttttttttttttttttttttttttttttttttcgtaaggtgtttttttttttttattatcgtggggttagtttttttatttgtgttattagtaggtgagaggcgggatgggtgtgttagcgagcgggggcggcgatggggaacgggtttcgtagtcgtggcgtgcggtttagaaacgtagattaggttcgtgggcgtttcgtttttgcgttttgatttacgttatcggttcgtatttggggttcggttttttgggttggtagggaggttggagcgcgagaaaggagcggaggagcgtttaggtagagtcgtagttggttgattttggagaaggcgcgttgggtgttgttgggacggtttaggtcgcggtttttcgcgtggggatgcgttgtggcgtagagttggtttcggcggggttaggcgtttgtgggcgggtgacggggatttagggttttcgttcgtgattttttttgggttgttttttcgggtttggattcgtttgttaggttgtgtgtagggttttcgttgtttttggtcggtaggcgttcgggttgtaggtgggtcggtaggtaggtgttagcgggaagggagtataggtagcgaggtgggatcggcgatttggttagggtgtcggtagaatggaatgcgcggtcggggttcgaggggtcggaggaaaggataggatgttggatggcgtgtttttggtgggagacgtgtgtgcggttttacgagcgagtcgttcgttgttgtttagcggttagaagttggagggtgaaatcgggcgggttgtttaggttaggacgtttttgggtagcgtagcggcgatttaaggcggtgggcggtgggcggaggtcggtgggaggaaggagggaaaaggaggaataggggaagaatttgggttgtgtttgtttgggcgagtgaggagaaggcgggcggaggagataggtagggaagagcgtggaaggtggtcgcggtcgttcgttgtgtgtggggttagggaagagggcgtgtgaggtggtggggagggcgtttgttcgaagggtaattggtagagggtcgcgggcgttggcgtatggttttgggttgtttttgcgatagtcggcgggtgggtaggaagaacggacgtgtttgagaagcggcggcgttttggaggtttgttttaaggggattggagtttggagagcgggtaagggtttaaggtaggaagcggttaaaggtgttttagggttgttatgggcgttgtttttcggcgggcgggttaaaaggtcggtttgttaggagtgggattcgaatttacgtttttaggggagattgcgatttgaacgtagcgttttagatcgttcggttattttgacggcgcgtcggggcgcgtcgtcgttggtatggttgggattcggcgcgaacgtttgcgtttttggtcggcgtttgtttgggttcggtgcgtaatcgacggatcgcgcgggcggagcgggcgttaagtgaacggagtcggttggcgttggcgtggacgttttcgcgtttttatttcggatttaaagggttcgcgtcgggtcggtcgtcgtcggcgtacgttttagttttcgcgttttcgttcgtcgaatttcgtagggcgtgcgtttatcgcgttttaggagtagcggtttgattgtttcgt

SEQ ID NO: 124 - DNA, 2514 bp, Artificial Sequence
  chemically treated genomic DNA (Homo sapiens)
tttttatttttttttttttttttttttttatatatatatagatatatatatatatatatatatatttatatttattgttgggttttttgggttgttaataggattaaatgaatgttttggttttatgatgtgtatgttacgttagagagttaagttagttaatatcgtttattgggatagaaggaacgtattgaggaacgtattgaggattagaagttagaatttttgaatttgtaaatttttttttttttttttttttttttttgagatagagttttgtttttgttgtttaggttggagtgtttattgtaatttttgtttttcgagtttaagcgatttttttgttttagttttttgagaagttgggattataggtatgttaattttttgtatttttaatagagatagggttttattatgttggttaggttggttttaaatttttgattttaggtgatttattagtttcggttttttatagtgttgggattataggtgtgagttatcgtgttcggtttgtaaattttttattttgtttagatattaattttagttttataaatagttatttaatatttttagtaaatggtgcgttttatattgatttgtttggttgttttatcgtgtttgttatattgttgtgtaacgagttatttataaatttagtagcgaaaatagtagatatttattattttatatagttgcggagggttaggaatttaggagtggtttagcgggcgattttgggtgttacgtggagttatatggggttaatgtgttggtcggggatgtagttatttgaagttttgtggggggaaggaggggtttttttaggtttgggaaggttgcggttgttttattacgtttttttttttattaggtttataggtttatagaagtaaaggttgagtatgttaggattgagttgagcggtttttattttttagtttatagttttttatagagtacgtaggggtcgtattagggttgggacggggttgcgattaggttaggggagtattttgggtaaattttgttggggataggttcgttgtgtttgatgtcgtgggagatgtacgagtagtgatttttattttattttattgtggtttcgtgattttgagcgagaatgtattggtcgggtttttagggggcgtttttttaggaatattttattttcgttttcgtgtgttgtcgagggtttttagcgggcgtttttttgataatattttattttcgtcgttgttgttgtcgggggtttttcgcgttttaggaggttttttagggcgatgttttggtttttgggttttttgattttatttttttagtttagtttttgaattttattttagattgagaggttttaggttggagtgatatggagggacgtgtttgatttttggaggataagaggcggtttattttatagtttttttagcgtgggagttttgaatatgggattcggagtattatcgtttagtaaattttgttgtagtttggagagagtgtcgcgggcgtttggtttgttcggtaggttgggtggttgttttttgttgagtttatagttatgttttatatgtaggacgtttgtttattatttggaggttttttagggattttgttagtttacggttgagtatagggtagattttattaatttatttataatttggttttttgatatattggtgttgtgaggaggaagatgtgggtatttttaggtttttggttttaggggtttgtgttggggtggggttcgttgatttgtattttggttggttttgtgattttgtttgtttatagtgagtagtttttggttaaaagttgtttattggattagtcggtgtttcgacggtagagttcgtagttgtgcgtaggaggacgaatttgtgtgtatgttttgttttagcgcgtttttggggttttttgagttggtttttgtgattagaaggatagtgttggttacgtaggtggtattttgggggtgtttagtatttattttttgttgagtagatgttttgggtggtaacggtttttgttaagtttgggtagtttaggttaggttttaattttttcgtttgagttcggttttttattttttggttaggttgatatttgtttttcgtaggtttttttcgtcggttttaggtagtataggatcgagggttgaagatgttgagtagttattcggtttgtttttttttagggatttgtgtggttttgttggcggtggttttggtttattatttttattggtgagtgaggtcggggttcgggggtttgggtagttttgggggtttttattgtgtgtttttttttttttttagttttggatcgttttttgtatgttaataaattttgtttagttttttgtaggggaatttttgggaggtagggaagtaggggatggtaggaatttattttgattttttttggggtttttgggtagtttttttatttttttgtaaaggggtttttgtttagaatatttttgaaggagttgagcggttttat

SEQ ID NO: 125 - DNA, 2514 bp, Artificial Sequence
  chemically treated genomic DNA (Homo sapiens)
atgaaatcgtttagtttttttaggaatgttttgaataaaaatttttttgtagaaggatgggagagttgtttaaggattttaggagggattagaatgagtttttgttattttttgtttttttattttttaggagtttttttgtaaagggttaggtagggtttgttgatatgtagagaacggtttagggttggaagaggaggggagtatatagtaaaggtttttaggattgtttaggttttcgggtttcggttttatttattagtagaagtaataggttaaagttatcgttagtagggttatatagatttttgagaagaggtaggtcgggtagttgtttagtatttttagttttcggttttgtgttgtttgaagtcggcgagaaggatttgcggggagtaggtgttagtttggttaaagggtgaggagtcgagtttaagcggagggattaggatttggtttgagttgtttaggtttggtaggggtcgttgttatttagagtatttgtttagtaggaagtgggtgttgggtatttttagggtgttatttgcgtggttagtattgtttttttagttatagagattaatttaagggattttaggagcgcgttgaagtaggatatatatataggttcgtttttttgcgtatagttgcgggttttgtcgtcggggtatcggttaatttaataagtagtttttggttaggagttgtttattgtaaataggtagagttatagggttagttaggatgtaggttaacgagttttattttagtatagatttttaggattagggatttaagagtgtttatatttttttttttatagtattagtgtgttaaggggttaggttgtgggtgagttggtgaggtttattttgtgtttagtcgtgggttagtaagatttttgaaaggtttttaagtgataggtaaacgttttgtatgtggggtatggttgtgggtttaatagagaatagttatttagtttgtcggataggttaggcgttcgcgatattttttttaaattgtagtaaggtttgttaaacggtggtgtttcgggttttatgtttagagtttttacgttggaagagttgtggggtgggtcgttttttattttttagaagttaggtacgtttttttatgttattttagtttgaaattttttaatttgaaatggagtttaaaggttaaattagggagatgagattaaaggatttagggattagagtatcgttttgggaaattttttggggcgcgggaggttttcgataataatagcgacgggggtggggtgttattaagggagcgttcgttagaggttttcgatagtatacggggacggggatggggtgtttttaagggagcgttttttggaggttcggttagtgtattttcgtttagggttacggggttatagtgggataaagtgaaagttattgttcgtgtattttttacggtattagatataacgaatttgtttttagtagggtttgtttaggatgtttttttagtttggtcgtagtttcgttttagttttggtgcggtttttgcgtgttttgtgggaaattgtggattgagaggtgggaatcgtttagtttagttttgatatgtttagtttttatttttgtgaatttgtgaatttggtggaggagagagcgtgatggggtagtcgtagtttttttaggtttgggggagtttttttttttttttataaggttttaggtgattgtattttcggttaatatattgattttatgtgattttacgtgatatttagaatcgttcgttaagttatttttggatttttgatttttcgtagttgtgtgagataatagatgtttgttgttttcgttgttaagtttgtgggtaattcgttatatagtaatgtaataaatacggtaaggtaattaggtagattaatatgaggcgtattatttattggaagtattggatgattatttatagggttggagttagtgtttgaataaaatagaagatttgtaggtcgggtacggtggtttatatttgtaattttagtattgtgggaggtcgaggttggtggattatttgaggttaggagtttgagattagtttggttaatatggtgaaattttgtttttattaaaaatataaaaaattagtatgtttgtaattttagttttttaggaggttgaggtaggagaatcgtttgaattcgggaggtagaggttatagtgagtattttagtttgggtaataagagtaagattttgttttaaaaaaaaaaaaaaaaaaaaaaaaagatttgtagatttaagaattttgatttttaatttttagtacgttttttagtacgttttttttattttaatgagcgatgttaattaatttagttttttagcgtaatatgtatattatggaattaagatatttatttaattttgttagtagtttaagaaatttaatagtgagtgtgagtgtgtgtgtgtgtgtgtgtgtgtttgtgtgtgtgtgagagagagagagagagagaaagtggggg

SEQ ID NO: 126 - DNA, 2325 bp, Artificial Sequence
  chemically treated genomic DNA (Homo sapiens)
agttttagtagtttggttcggtcgcggcggcggtagtagtagtagcggcggcggcggtcgcggcggttttggggtattcgtagtattacgtatttgtttgtatcgttattatttataacgtggcggattcgcggagattttattgttttattatgggtagggcggggttttggggtatttgcgtttcgcgtttttcgcgtttttggagtaaattttttatttttagtggaggaagtgggagttcggggatagggtgaagagagaggacgggtttttagtgtaatcgtagagttagttatagaagttttacgaaagtggaagttagtttgttagtttttttatttagtttggtgcgttttatttttagtagtaggtgttcgagtattgttttattaatattggggttttagggatttcgaacgttacggcggataaattagaggttaattgtttgggatttggggtgggtgtgtttgaatttgtgtggtattttcgcgtcggggcggttaaagcgttttgacgtttttggttaagtttgcgcgttttttcgtttggtttaaagggaggcgattagatagtgtaagtttttatttttttttaattttgtgatttcgtattttgcgtatcgaagatttttatttgttttgtacgttttttttttttttcgttaagtaattacgtgttttgaaatgggaaagggatatagatgttcggttgggttttttcgggtgggtttttgaaatgcgttttggttagtatatggggtgggagtattttgttcgagttttatttttttatttttttttcgtcggttcgtaggaggttttgacgttagttaggtatttaatggtaagaggatgaggacggcgtttattagtacgtaatttttggagttggagagagaatttttttttaatatgtatttgtttcgatttcggaggattgaaatcgttatttatttgaatttgtcggagaagtaggtgaaaatttggttttagaatcgtcgagtgaagtataagaaggaggggaagggtacgtagaggaatagttacgcgggttgtaagtgcgtcgggagttaggtgtattacgcgcgtttcgaggatgaggattttttgtcgtcggttttagttaacgatgataaggagattttttttttatgagggagggtttttttttttatatttttcgtttttggtagattaggtaacgttaaggcgtggggtatttaggggttagaatttttgtttattgtagtggttttatttggagaagaaacgaatttggaagttttggaatggataagtcgggatttgatttttcgcgttttttttttgatttgtttatttaggattttaatttgaagttatagatttttttaaaaaatgtaaataatttataatttaatttatttttgtcgtataatagaggaaaaatagggttggtttaagtttaatattgtatggggtttttgaaagtatatgttagttttttatttttatttttttttagaattcgataagaatataggatttattgattattttttgttgtcgtttttaaataaaaatatttaagttgaaaataatttagaaaattagattttgtaggttttgttttttgaaatttcgtttggggagaatttaaaatttaagtcgttggaagtttttttgtatgtgaataggtttatataaaatttatatttatatttatttaaataaatgaaataaaaattagaattttaaatttgtggtgtttgttttttttatttttttttgtttttttttttaatgtttagagaaaggtatatgtaggaaaaagttgtttgaggaattcgaggaaaatgttgagtaagaatttggtaatgtgggttttttgattgagggagtttgtggtttaatgggttttttatgtaatagaattttcgttaaggagatatttttagttatgatggtatttattaggtagtgtttttttatttttaaaataggtaatttttttatagttgataggataaattattttatttggaatgatattgattattaacgataggtaaatttttatttagtaaggaagggtaaaaattttttatttagtttttgtttttttttttttatttttttattttttttagtacgaaaatttgaattatgtgaaggaatttgtagagttagaatagttttaggaagagtaataatttattaaataggttagaagtaaatagtggaaatttaataacgatgttataagtagaattagcgggttttttttaatgttaagaaaataaaaagttagggataggaagtattttgtttaaagatttat

SEQ ID NO: 127 - DNA, 2325 bp, Artificial Sequence
  chemically treated genomic DNA (Homo sapiens)
ataaatttttgaatagaatattttttgtttttgattttttgtttttttaatattgagggaaattcgttaattttgtttgtagtatcgttattaagtttttattgtttgtttttgatttgtttgatggattgttgttttttttaaaattattttgattttataaatttttttatataatttaagttttcgtattgagagaaatgaggaagtagaaagaagaaaataaaaattagatgggggatttttatttttttttgttaaataaaggtttatttgtcgttaatggttagtgttattttaaatggagtgatttgttttattaattgtgaggaggttgtttattttaaggatggagaggtattgtttggtagatgttattatgattaaaggtgtttttttggcgaaagttttgttatatagaaaatttattgagttataaatttttttagttaagagatttatattattaagtttttatttaatatttttttcgaattttttagatagtttttttttgtatatgtttttttttagatattggaggagggggtaggagaagatagggagagtaaatattatagatttaaaattttggtttttgttttatttatttaaataaatataaatataaattttatataaatttatttatatataaagggatttttagcgatttagattttaaattttttttaggcgaaattttagaaagtaagatttataaggtttaattttttaaattatttttaatttgggtgtttttgtttgaaaacgataatagaaaataattaataaattttgtgtttttatcgagttttgaaagagagtagggatggggaattgatatgtgtttttaaaaattttatatagtgttaaatttaaattaattttgttttttttttgttatacgataagaatgagttgaattataggttatttatattttttaaaaaaatttgtaattttaagttggagttttagataaataggttaagaaggagacgcgaagggttaggtttcggtttgtttattttagaatttttaggttcgttttttttttagatgggattattgtaatgagtaaggattttggtttttgggtgttttacgttttggcgttgtttggtttgttaggagcgggggatgtgagggaggaggtttttttttataagggggaaatttttttgttatcgttggttgaggtcggcgatagggagtttttattttcggagcgcgcgtagtgtatttggttttcgacgtatttgtagttcgcgtgattgtttttttgcgtgtttttttttttttttttgtgttttattcggcggttttgaaattagatttttatttgttttttcgataggtttaggtaagtggcgattttaatttttcggagtcgagataggtatatgttggaagagaattttttttttagttttaggagttgcgtgttagtgaacgtcgtttttatttttttgttattgggtatttggttggcgttagagttttttgcggatcggcgaagagagggtagagaggtaaggttcgggtaaggtgtttttattttatgtgttaattaggacgtattttagggatttattcggggaagtttagtcgaatatttgtattttttttttattttaaggtacgtggttgtttagcggggaagaaaagagacgtgtaaagtaaataaaggttttcgatgcgtaggatgcgaagttataggattaaagagggatgggggtttgtattatttgatcgtttttttttgagttaagcggagaagcgcgtaggtttagttaaaaacgttaagacgttttagtcgtttcgacgcggggatgttatataggtttaaatatatttattttaaattttaagtagttaatttttggtttattcgtcgtgacgttcgaggtttttaaggttttagtattaataaggtaatattcgagtatttattattaggagtaaaacgtattaggttgagtggagaagttggtaaattaatttttattttcgtggaatttttgtggttgattttacggttatattaaaagttcgttttttttttttattttgttttcgggtttttattttttttattggaggtggaaagtttgttttaggagcgcgaaaggcgcggagcgtaggtgttttaagatttcgttttatttatggtgaggtagtggaattttcgcgggttcgttacgttgtaggtggtggcggtgtagataggtgcgtggtgttgcgggtgttttaaggtcgtcgcggtcgtcgtcgtcgttgttgttgttgtcgtcgtcgcggtcgagttaggttgttggggtt

SEQ ID NO: 128 - DNA, 2541 bp, Artificial Sequence
  chemically treated genomic DNA (Homo sapiens)
aatttagttttatagtttatattttattttaaaatatagtttaattgggttaaaaataaatatttgaaaattaaatataagaagaaaatattaaattattagaaaatattggtaaatattgagttatataaatttgatattgttaaaatatttaataagtaataaattacgataattgtgtaaggtttaagtttgtgtgtgtgtgtgtgtgtgtttgtgtgtgtatgcgtgtgtttatttgtagggtaaaagtttagaagaatttatattgaaatgttgaaagttattgggtaaagggttttgggttttagaggtttttgacgattgtaattattttgtttttttaattgaatgttttttttttatattgtatatgattatttttgaaaaaaaaaaataaaagagtatgtcgttttttttttgtagggaggtagagtttaggtggttattaaggggttgttgttatagtttagggaaagttagaatggtaggtacgggagttttgggaggggttttaattaggtttgttttttggttttagaaagagtaggggtttgtagtgaagtttatagagttttttgtgggtcgtatgggtcgtttttaggtttttatttttttttttagttatggtcgtttagtgtttttttatttggtggtgtggggatattgggaggttttttgggttttttaatttttttatttaatttttagtttaggtttggttttttaggatttagtttttagtttttgtgaggttgggttattttgtaggattgtagttttgggttttttgttttggtgttagggttttggggtttatgaatgtagttttagtattcgggaggttgaggcgggagaattatttgaattcgggaggcggaggttgtagtgagtcgagatcgtgttattgtattttagtttgggcgatagagcgagattttgttttaaataaataaataaataaatagtagttaatatttttcgagggttttttagggttaggcgcggggtagttttatgtaatttttaagtaattttgggaggtaggtattattgtttattgtttttttcgattttagagataagaaattaagatttagaatataagaaatttgtttaaggttaaggagaagtggaggcgtggggaggaaataaagttatttgatattagagtttatgtttttaaattttaagtttgggatttttgattaaatttcgtttttgtttgtattttgggaagattttttttttttttaggtaagtgttcgcggggtttgagttttcgatagcggggttttaggagttacgttgtggggtttgttattcggtttttttttgtacgcgcgatcgtttatttgagcgtagtggttggagttgggattttagcgtagtttttgagcgtttacgtcgatttttttaattataagaggttttcgtgttaggtttttagatttggttaattagggaagatttttttttgttatagaatggggtcgaggggtttaggaaataggtagtttttagttataaattatcgcgtcgttttcgttggttttttttttttatcgagttttagtttttttttttataagtcgggttagtagtgtttattttataggttggcgttagtttcgtaagggttttattatcgcggtcggttagattttcggcgggttagttttggcgttgcggttatttagtttgatgatttttggttaggtttagttttaattgttttaaagaatttcggattcgtatttcgagttcggcgttttagcggcgaagttgatgggtttcgtaggagtttttgcggtgagaatcgagttttggagtttttggagttttcggagttttcggagttgtagtcggggtagtttttttttcgtcgggagtttagcgttttcgagagtttagaaatttatcgcgcgtaggagttggtgcgggcgtttcgggtaggttagatttttgtgagtcgtagtttcgaaattgaggttggtgtagattcgttttgggagttaggaggtgggatttgttttcgttagttcgcgagttttggttaaggttagagttcgtgaggggaggggcgcggggcgggcggagagttagtcgagtgggggcggcgtttatcggtggtgggattatggcgggagcgtagcgtatttttttcgggcgggtttataaatgttatgtaaaagttaatttcgtaggggtttgcgttttttttcgtttaggttaagaagatttattgtggatttttggagaatttttagggttttgaaaagttttaagtatttagtagggttggtagttttgagcgttggtaaggttaagtgggttagaggagattttcgttaagtcggtgatttatttattcgtttatttttttttatttttgatgggttaagtatttgttatgtgttacggatatagtagagcgaaaggagacgttgtttttcgggaatttgtagtcgtttgtagaggcggttttttagtagttgcgtattcgggtggatagcggcgtttttgttcgtttagtgttta

SEQ ID NO: 129 - DNA, 2541 bp, Artificial Sequence
  chemically treated genomic DNA (Homo sapiens)
taggtattgggcgggtagaagcgtcgttatttattcggatgcgtagttgttaaggggtcgtttttgtaagcggttgtaaattttcggagggtagcgttttttttcgttttgttgtgttcgtagtatatggtaggtatttggtttattaagagtgagagagggtgagcgagtgagtgagttatcggtttggcgagggttttttttgatttatttagttttgttagcgtttagaattgttagttttgttgggtgtttgggattttttaaagttttgggaattttttaagggtttatagtaagtttttttgatttaagcgggaaagagcgtaggtttttgcggggttggtttttatatggtatttatagattcgttcggagagggtgcgttgcgttttcgttatagttttattatcggtgagcgtcgtttttattcggttgatttttcgttcgtttcgcgtttttttttttacgggttttggttttaattagagttcgcggattggcggggataggttttattttttggtttttaggacgggtttgtattaattttagtttcggggttgcggtttatagaagtttaatttgttcgggacgttcgtattaatttttgcgcgcggtgagtttttgggttttcgagagcgttggattttcggcggaaaggaggttgtttcggttgtagtttcgggggtttcgggggttttaggggttttaggattcggtttttatcgtaagggtttttgcggggtttattaatttcgtcgttgggacgtcgggttcggggtacgggttcggagttttttggagtaattgaggttgaatttggttaggggttattaggttaaatgatcgtagcgttaggattggttcgtcgaggatttggtcggtcgcggtggtagggtttttacggagttggcgttaatttgtggggtgggtattgttggttcggtttatggaagagaaaattgaggttcgataagagaaagggattagcgaaggcgacgcgatgatttgtgattggggattatttgttttttgggtttttcgattttattttgtgatagggaaaggttttttttgattggttaaatttgggggtttggtacgagggttttttgtgattggaggggtcgacgtgagcgtttaggggttgcgttggagttttagttttagttattgcgtttaagtggacggtcgcgcgtgtagagggaggtcggatagtagattttataacgtggtttttggggtttcgttatcgagagtttaggtttcgcgggtatttgtttaggagaggaaagaatttttttaaagtgtagatagagacggaatttaattaggagttttagatttggagtttggaggtatgggttttggtgttaggtgattttgttttttttttacgtttttatttttttttgattttgggtaagttttttgtgttttgaattttagttttttgtttttaaaatcgggaggggtaatgaatagtagtgtttgttttttaagattgtttgagaattatatgagattgtttcgcgtttggttttaggaaattttcggagaatgttggttgttgtttgtttgtttgtttgtttgagatagagtttcgttttgtcgtttaggttggagtgtagtggtacgatttcggtttattgtaattttcgtttttcgggtttaagtgattttttcgttttagtttttcgagtgttagaattgtatttatgggttttagggttttagtattagaatagagggtttagagttgtagttttgtagggtggtttagttttatagggattagaagttgggttttggagagttaagtttgggttgggaattgggtaggagggttgggaggtttaggaagttttttagtgtttttatattattaagtgaaaggatattgagcggttatgattgggggaggaggtggaggtttggaggcggtttatacggtttataaggggttttatgggttttattgtaggtttttgttttttttggggttaaagggtaagtttgattgaggttttttttaaggttttcgtgtttgttattttggttttttttggattgtgataatagttttttggtggttatttggattttgtttttttgtagggggggaacgatatatttttttattttttttttttagaagtaattatgtataatataaaaaaagaatatttagttaagaaaataaaataattatagtcgttaaaaatttttgaaatttaaaattttttatttagtaatttttaatattttagtgtaaatttttttaggtttttattttgtagataaatatacgtatgtatatatagatatatatatatatatatataaatttaagttttatataattatcgtggtttgttatttgttgggtgttttgatagtgttaggtttgtataatttaatatttattaatattttttaataatttaatgttttttttttatatttgatttttaagtatttatttttaatttaattggattgtattttagagtaagatgtgaattatagagttagatt

SEQ ID NO: 130 - DNA, 2501 bp, Artificial Sequence
  chemically treated genomic DNA (Homo sapiens)
tttgtaaatggagatatttttattatttttatagtattatatgtttttaaagtttgtatttatattttgggtgataaatgaaggataagatttttttttatttttgtgaggatgattatagtatgattggatgggtttgttatgatttttatttttttttgtgtttttattatcgttttattaattttagtttttttttatagggtagtatagaatttaattagtagaaagagatttagttatgtagattagagatttgtttaagtgacggtatgtaagaattaggaaggaaagttttttgtttaaatattaataggttttttttttaaagtaattattattttttaaatttaatttataaggtgatagtatttttaaattaattaaattagaatttcgggttggataattttaaatatgatttattagtattttttattaattattggttttttaggtttttaagtttatttattaggaattttatttttaatattattttattaattttagttgtaaataagagaatatttaaaggttgaggaatttttagcggtaaagttttgtttacgttaagtaataaaggataagttagtttttgttgtgattattttgttgtattgataagttacgtatttttatttaaggatttaaatttttattttttttaagaattgggttaaaatcgataaattaaatttatttacggtttattgattaaaggttgttgtataataagtttttgttatgtttagtagttggatttatagcgttagaaatttataattgtttgatttttttttttattatattgcgaaaattgttttttaaatgtaattaattttaaaattttaatagtatcgtggttaggcgtggtggtttattattgtaatattaatattaggtataggcgaggggattgaggttaggatatcgaaattagtttgggaaatatacggagattcggtttttggaaaaataattagttttgcgtggtggtgggcgcgaggtttcggttaatcgggaggttatagtgagttatgatgatattgtattatagtttgcgcgacggtttatgttagtaagttttggagtatttgaaataagttgtgttgggtattttatttattggagagcgattagtgattgatgtttatttatagcgattagagacgtatgtttcgatagtagtataaatttagtaggcgcgaataaatggtaaagagaaattgggtaaataagtattacggttttttagttgagaaagtgggggttttaaaaagggttttttgttgatagaaagggacgtttaattatcgaaatcgtagagggtgcggttttggcgtttgagcgcgtagattatatttatggcggtgatcgttttgcgtttggcgtgttttgtataggttacggcgtttcggattacgttttttaggaatatttttagtatttcgcgagttttttcgtagatgaggtcggagatgcgttttacgtcgtcgcggcgagtaaggcgtcggatggtcggtttggtgatgttttggatattgtcgcgtagtattttacggtggcgtttagcgtcgtttttgttaagatttttttcgtttttgtcgcggttagatatgacgagtaagaggagttttatttaacgttttgtgaggattttggtttgaggtagcgtttttatacgatagttggcggatcgaattgagaatttgaaagaagtcggcgggaagtttcgtttcggtgggggaggggaaatttaaagggttaaatcgaaatagggggaaaaaaaaagcgagttttttgttttcgtgttttgaattttgtaacgtgtatagtattttgttattacgttatgaggttttaaaaaattgtttttgaacgtagaagatatatattaatattgtgggaaatataagaaaggataagaaattaagaaattataatgttattttattatataggttagttaattatgtattttgtagagtagttgtatatatttttttaagaaaatgtatatagtgttgtatatggagttttgtaatttttttatattgattataatttaattaatttttattaaagagataaaagtgatgttttggtgtttatgttttttaggaattattaatagttataattagttttttagtaattttttaatcggttgtattttaaaaataatgttttttatatttaatataaatgtattttttttttatatttgggattaatattgaaatttatgattttattatattaaaatttaaattttattatattaatatttaaaattgtattagaggttttatgatttggtattacgggttttcgtattattttttttttaaattttttaatttgttttattaaggtttttggataattttagagattttttgtgaagtttgaataaaattttttcgagattttgataattgtattagttttaggatttaattggaatagaattaaaatttttaaaataagtttttata

SEQ ID NO: 131 - DNA, 2501 bp, Artificial Sequence
  chemically treated genomic DNA (Homo sapiens)
tataagagtttgttttaaggattttaattttattttaattaagttttaaagttaatgtaattattaaaatttcgaagagattttatttaaattttataaaaggtttttaaagttgtttagaaattttggtgaaatagattaggaaatttggaaaggaaataatgcggagattcgtagtattaaattatgagatttttaatataattttaaatattaatgtaataaaatttaaattttggtgtaataaaattataaattttaatattggttttaagtatagagaaaaagtatatttatgttgaatgtggaaaatattatttttaaaatatagtcgattaaaaaattgttggggaattgattataattattgataatttttaagaaatatagatattaaaatattatttttatttttttaatagaaattggttaaattataattaatataaggaggttataaaattttatatataatattgtatatatttttttggaaaaatatgtgtaattgttttgtaaaatatatgattaattagtttgtgtgatgggataatattgtagttttttaattttttgtttttttttgtattttttatagtattgatgtatattttttgcgtttaaaagtaattttttaaagttttataacgtggtaataaaatattatgtacgttataaaatttagaatacggaaataagaagttcgttttttttttttttttatttcggtttggttttttagatttttttttttttatcggggcgggatttttcgtcgattttttttaggtttttagttcggttcgttaattgtcgtataaaggcgttgttttaggttagagtttttataaagcgttgggtgagattttttttgttcgttatgtttggtcgcggtaaaggcgggaagggttttggtaaaggcggcgttaagcgttatcgtaaagtattgcgcgataatatttagggtattattaagtcggttattcggcgttttgttcgtcgcggcggcgtgaagcgtattttcggttttatttacgaggagattcgcggggtgttgaaggtgtttttggagaacgtgattcgggacgtcgtgatttatatagagtacgttaagcgtaagacggttatcgttatggatgtggtttacgcgtttaagcgttagggtcgtattttttacggtttcggtggttgagcgtttttttttattaataaaaggttttttttagggtttttatttttttagttgaggagtcgtgatgtttgtttgtttagtttttttttattatttgttcgcgtttgttgagtttgtgttgttatcggagtatgcgtttttagtcgttgtaagtaggtattagttattaatcgttttttagtaaataaaatatttaatataatttgttttaggtgttttagagtttattgatatgggtcgtcgcgtagattgtagtgtagtgttattatggtttattgtagtttttcgattagtcggaatttcgcgtttattattacgtaaggttaattatttttttaaagatcgggttttcgtgtgttttttaggttagtttcgatattttggttttaattttttcgtttatgtttaatgttggtattatagtagtgagttattacgtttggttacgatattgttgaggttttagggttagttatatttaaggggtaattttcgtagtgtagtggggaggaaagttaagtagttataggtttttggcgttgtgaatttaattgttgaatatagtaagaatttattatgtaataatttttaattagtggatcgtaaataagtttagtttatcggttttggtttaatttttgagaaaggtgagaatttgaatttttgagtagaaatacgtagtttattagtataataaagtgattataataaagattaatttattttttgttatttaacgtgggtagagttttatcgttgagaattttttagtttttgagtgtttttttatttataattgaagttgataagatggtattaaaagtgagatttttagtaagtaaatttaaaggtttgaaggattagtgattaatgggaagtgttaataagttatatttgaggttatttaattcgagattttgatttaattggtttaaggatattattattttgtgggttagatttgaaaaataataattgttttaaggaaggaatttgttggtatttaaataaaaaatttttttttttgatttttatatgtcgttatttagataaatttttggtttatatggttggatttttttttgttagttaaattttgtgttattttgtgaaaaagaattgagattaataaaacggtagtgagaatatagggaaagataaaaattatagtaagtttatttagttatgttgtagttatttttataaggatagggaaggattttgttttttatttattatttaaagtgtgagtataaattttaaaaatatatgatattataggaataatgaagatgtttttatttgtaaa

SEQ ID NO: 132 - DNA, 2257 bp, Artificial Sequence
  chemically treated genomic DNA (Homo sapiens)
tttgttttaagggttacggtgtttataataggacgggtatgggacggtgtattcgaggttcgagattttaagaggtttcgttaaggaatcggttagtggagaaggggttattagttttagggggtaggagagttagggagggcgtatagttgggttgaggtgggagtggtttttttcggaaaggcggggagggcggttttgtgttgacggtggaggttattttggttcgttgtattatggtttagttttgttttaggtttgtcggggtattggtgggatataggcgaggtggggttttggttaagaattgtgaggtttgtttattaggtgggtttcgtagtgtcggtattcggttagggtagttaggagagaggggaggatttggggttttgttttttcggtttttaaggttggggtgttgttggtttttacgtatttatagaaaggttagggcgaggtagttggagtttttaaggattttttttttgaagattttttggagtcggttttttggttttatcgtgagttaggttttttttttggaggttaagattagagggttggacgtttattttggttttagtttggtttttaggttttattcgtttttcggttgtaggcgaaggtttttatttcggggttggtttttatggaaagagtttttagattttagaaggtatagggagaagacgttaattaatagttttgtatttgggcgtttttgaggtggggaataggaaagttcgtcgggtaggttaggtgtgaaggtagaggttacgtatagcggtcggttatattcgtttgtagttgttcggaaattttatcgggatttaaggtcgtaggtttttattaaataggttcgttttttgcgtaggtttttagggaataggtttgttttttgtgttttttttgggttcggttgagataatttttcgtttgttgttacgttggtaatatttcgttattattttcgtttttttttatatcgggttgatgtcggtcgcggttttgagtagagtggatagggtagttttgtttttgtacgttgtttttggagttatagggttttgtttagttttttagtttttgttggaaaataatttttgtaaaaggttattgttaggagtttttattttttagtttatatgggtttttttagggtttatttttttcgttatatttagttattgtaagaaaagggttttagagggttttcgttttaaaatttcggaggtatcgtgttgaggagggtcgcgggcgggtttattggtttagcgtcgttttattttttgggttcggtttagtttacgttattaaagggattttcgtcggtggtcgagcgtggcgggggttcgtacggggtatagaggtcggagtcggtgtttgatttttttttcgtaatgtagggtttgattttggtataaggcgttacggtcgcgtagtagttgttgagagtatttaggttttttttggattgggagatgttgaagtcgttgaaggaacgttttagtttttcgtggtttacggacgggatggagatggacgtgtcgttgtttcgtaggtttttttcggggggtttgtagttcggggtgtttttttgtcgtaggaattttatgttggcgcggttgttttcgtcgtaggcggatagcgatcgttcgtgggtaggcggcggcgggatgcgtattagggagtcgtggttttttacgggggaggtgtcgtggttttggcgcgggtggttttgtggttgttaggaggtggagggcggatattggatagggggcgcggtcgggggcgtcgagaagtttttttggttcgtggagttgttggagcgtacgattttgataatgtagtcgtgtttgtcgatatgttttcggttgtttttcgggttgtggtacggcggcgtcggtttcggttttttggttttaaagtaggtttcggtttttgtcggggggatgtttattcgttgtatgtagatatttattaggaagtttagttttttttttatggataagatttgtaaaaggggttgttgggttggggtgcgagggttcgttttaggagatgtggggatttaggttgtttttaggaaatgggggggtttaggttggttttaggaaataggagagatttaggttagttttaggaaacgggggatttaggttagttttaggagatgtggggattcgggttgtttttaggaaatgggggggtttaggttggttttaggaaataggagagatttaggttagttttagga

SEQ ID NO: 133 - DNA, 2257 bp, Artificial Sequence
  chemically treated genomic DNA (Homo sapiens)
ttttgggattagtttgggttttttttgttttttggaattagtttgggtttttttattttttgggagtagttcgggtttttatattttttgggattagtttgggtttttcgttttttgggattagtttgggttttttttgttttttggaattagtttgggtttttttattttttgggagtagtttgggtttttatattttttgggacgggttttcgtattttagtttagtagttttttttgtaggttttgtttatggagaagaagttggattttttggtgaatatttatatgtagcggatgggtattttttcgatagagatcgaggtttattttggggttaaagagtcggagtcggcgtcgtcgtattatagttcggaagatagtcgggagtatgtcgataggtacggttgtattgttaagatcgtgcgttttagtagttttacgggttagaagaatttttcggcgttttcggtcgcgttttttgtttagtgttcgttttttattttttggtagttatagagttattcgcgttagggttacggtatttttttcgtgggggattacggttttttggtgcgtatttcgtcgtcgtttgtttacgagcggtcgttgttcgtttacggcgggggtaatcgcgttagtatggagtttttgcggtaggaggatatttcgggttgtaggtttttcgaggggaatttgcgggatagcgatacgtttatttttatttcgttcgtggattacgaggagttggagcgtttttttagcggttttagtattttttagtttaaggagaatttggatgtttttaatagttgttacgcggtcgtggcgttttgtgttaaagttaggttttatattgcggagggagagttagatatcgatttcgatttttgtatttcgtgcgggttttcgttacgttcggttatcggcgagggtttttttggtgacgtgggttgggtcgggtttaggaagtgaggcggcgttgggttagtggattcgttcgcggttttttttagtacggtgttttcgaggttttgaggcgggaattttttggggttttttttttatagtaattgagtgtggcgggaagggtgggttttggaggggtttatgtgggttgaaggatgggggtttttggtagtgattttttataaaagttattttttaataggggttggagggttgggtagggttttgtggttttaggagtagcgtgtaggagtaaggttgttttgtttattttgtttagggtcgcggtcgatattagttcggtgtgaggaggggcgggagtgatgacggggtgttgttagcgtggtaataggcggggggttgttttagtcgagtttaggggaggtataaagggtaggtttgttttttgaggatttgcgtaaagggcgggtttgtttggtgaggatttgcggttttgggtttcggtggggttttcgggtagttataggcgggtgtggtcggtcgttgtgcgtggtttttgtttttatatttgatttgttcggcgggtttttttgttttttattttaggggcgtttaaatatagagttattggttggcgttttttttttgtattttttgggatttgagggttttttttatggaagttagtttcgaggtggagattttcgtttgtagtcgaggagcgggtggggtttgggaattaaattggagttagagtggacgtttagttttttggttttggtttttagagggagggtttggtttacggtggggttagggagtcggttttaaagggtttttaaaaagggggtttttgggggttttagttgtttcgttttggtttttttgtgggtgcgtgagagttagtagtattttagttttggagatcgggggggtaggattttaagttttttttttttttttgattgttttggtcgggtgtcggtattgcgagatttatttggtgagtaggttttatagtttttagttagggttttatttcgtttgtgttttattagtgtttcgatagatttggggtagggttgggttatgatgtagcgggttaggatagtttttatcgttagtatagggtcgtttttttcgttttttcggaggaaattatttttattttagtttagttgtgcgttttttttagtttttttgttttttggagttgatggttttttttttattgatcgattttttagcggggttttttggggtttcgggtttcgggtgtatcgttttatgttcgttttgttgtgggtatcgtggtttttggggtagg

SEQ ID NO: 134 - DNA, 2434 bp, Artificial Sequence
  chemically treated genomic DNA (Homo sapiens)
  unsure (1598, 1841, 1846, 1848, 1869, 1871, 1873, 1874, 1878, 1880): unknown base
ggtttcgtagtatattttgggagttgtagatagtaaatttggagttttatagagtattttatttttttattatttgtgggttaataggttgtgttagttttttagggttgttttatagtattatagattgggtatttttaataatagaatgttattgtttcgtagtattggaggttatgagtttaagattaaggtgttagtagggtgggttttttttgaggttgtgtaggaaggttttgttttaggtttgtttttttatgcgtgggtggatattttttttttgtgattttttattaagggtgattttggtgagggttttaaagaggagatttggatagaatgttggtagataaatgtgttagtggaaattagagggtagataggattttatttatgtttagggttttttggggatagatttgtttaagtagtaattatttttaatcgagttttgtttttggaaagttaggtaataggtggggttgggttttttgggatttgtttagtgattcgattatgtgggaggtttgtagtgggtggttgggtggggggtggtattaatgttattatgtttaattttattgtattatttattttttaggttttgtttttaattttttttgattaggttttgttttggtttttagttattttgttttagtgggtgttttagtttatttattgattaagtgagggattgattttaggttataaagtgttgtgtttatgtgatttgagaatacgtgtgcgtagagtgtttttatagtgtttttgtaaagttgagtatgtatatgttttgttagtgtgtaggtagtttgtttatatatgtttaggagtgtgattttatgttttggtagatggggaaggagagagggagttgtgtttagggtttttcgattatttttatgggtgtatgtttgtgttttttgttaggggtgtttggggaagattttgttttgggtgttttggattatttgtgtgtgtgtgtgtgtgtgtacgcggggacgcgtacgtgtattagggggtgtattgtgttatagtatttttaattaattttgtatgtgtgtatatgtttgtgtgtgtgtgttttataggtgtgagcgagtggatgtttttattacgtgtttgtatatgtgtgtgtgtatttgtattgtttttgtatatttgcgtgtgtttcgtgagagcggagtttagtatgtgttggtatttgtaggaatatgtgagtgtgcgttttgtgggtttttgttttgatggttttttatttgtttcgagtgttacgacgacgaggatggggattatattttcggagtttgaggatttaatataggtttagttttgtgtagtcgttcgttaagtcgttagaggacgagtcggacgtcgaaggttacgagtggacgattgtagttagtttttaattcgtcgatttcgcgtttttttattggtttcggtttgatgatttcggtttcggggtgttttcggtttttttttatcgcgtcgtcgtttttttttttggtataatttttagtcgcggggtcgtagattttaagagttttatgagtttttcgcgttttgtttatcggtttcggtttcgatttttnttttagatcggattagagaggtgggaagtttgggggtattcgttgtgggtgtttcgttttcggggttgggtttcggggagtcggcgcggcgttcgttttttgttcgttagttttttgggagtttaggcgcgggtagtcgtttgtgtttttgggaagggcggagttgcgtttcggggagatacgttttgtagtcggtagtttagtcgtttttcgttggtcggtcgtttcgtgagggtttcgtangcggnangggtcggggttggggcgggtntngnngagnangggggtttcgggttggggtcggttcggtttttcgggtggcgcgcgggtcgaagaattaggaggatcgtcgggtcgggtcgtttgttttttggaaaaattttggcggttttttttttggtgttcgtggatttcgtcgtggcgttttttagggtcgcggatttttgtttatcggtcgcgttagttgttttggagtagaaaggattttttttttttcggatcgagtttcgagtttcgagttttatggagtaggtaagcgtcggagtttcgaggttaaggttcggtcggcgggcgttttggtattttttttcgttttcgagggtgtttgttcggttcggtcgggattggttgggaaatcgaggtcggaagaggtcgtagtttagtaaggaatcggtttgtgtggggtgggggtgggatgggagatttttttttaattttattagttttagtttagttgtggttttcgtcgtgttatttagaaaattagcgttaaattttagttttgtttgggatgtggattttgtttggggagagtttcgtttaggtttttttagggt

SEQ ID NO: 135 - DNA, 2434 bp, Artificial Sequence
  chemically treated genomic DNA (Homo sapiens)
  unsure (555, 557, 561, 562, 564, 566, 587, 589, 594, 837): unknown base
gttttggaaaagtttgaacgggattttttttaggtaaggtttatattttaggtagggttggggtttgacgttggttttttgagtgatacggcgggggttatagttgggttggggttggtggggttggggaggggttttttattttatttttattttatataaatcgattttttgttggattgcgatttttttcggtttcggttttttagttagtttcggtcgggtcggataggtattttcgggggcgggaaaaggtgttagagcgttcgtcggtcgggttttagtttcgggatttcggcgtttgtttgttttatggggttcggggttcggggttcggttcgggaggaggggggttttttttgttttaggatagttggcgcgatcggtgggtaaaggttcgcggttttggagaacgttacggcggggtttacggatattagaggaggaatcgttaaggtttttttaaaggataagcggttcggttcggcggtttttttagtttttcggttcgcgcgttattcgggaggtcgaatcggttttagttcggggtttttntntttnntnangttcgttttagtttcgatttntntcgtntgcggggtttttacggagcggtcggttagcggggagcgattaggttgtcggttgtaaggcgtgttttttcgggacgtagtttcgttttttttaggaatataagcggttgttcgcgtttgagtttttaaagggttggcgggtagggagcgggcgtcgcgtcggtttttcggagtttagtttcggaaacgggatatttatagcgggtgtttttaaattttttatttttttggttcggtttggggnaggggtcggggtcggggtcggtgggtagggcgcggagagtttatggagtttttagggtttgcggtttcgcggttgggggttatgttaagggagaaagcgacgacgcgatggggagggatcgagagtatttcgaagtcgggattattaagtcggagttagtggaggggcgcgaagtcggcgagttggaaattaattgtaatcgtttattcgtagttttcggcgttcggttcgttttttggcggtttggcgggcggttgtatagggttggatttgtgttggatttttaggtttcgaagatatggtttttattttcgtcgtcgtgatattcgggataagtggagagttattaggatagggatttatagaacgtatatttatatgtttttgtaggtgttagtatatgttgggtttcgtttttacgggatatacgtaggtgtgtaaggataatgtaagtgtatatatatatgtgtagatacgtagtggaagtatttattcgtttatatttgtaggatatatatatataaatatatgtatatatatagagttggttgaggatgttgtaatatagtatattttttaatgtacgtgcgcgttttcgcgtgtatatatatatatatatataggtgatttagggtatttagggtagaattttttttaagtatttttaataagaagtataaatatgtatttatagaagtaatcgggggattttgggtataattttttttttttttttttatttattaggatatggagttatatttttaggtatgtgtggataggttgtttatatattggtaggatatgtatatgtttaattttataaggatattgtgggaatattttgcgtatacgtatttttaggttatataaatatagtattttgtaatttggagttagttttttatttggttagtgagtgggttgaagtatttattgggataaggtggttgagaattaggatagggtttggttaggaggggttgagggtagggtttgggaagtgagtgatgtaatgaggttgggtatgatggtattggtattattttttatttaattatttattgtaggttttttatataatcgggttattaaataaattttagagggtttagttttatttgttgtttggttttttagaaatagaattcggttgggaatggttgttgtttggataggtttgtttttagaaagttttgggtatggatggagttttgtttattttttggtttttattgatatatttatttattaatattttgtttaagttttttttttggagtttttattagaattatttttaatgaagagttatagggagaagatgtttatttacgtatgaggagataggtttggaatagagtttttttgtatagttttagaagggatttattttgttgatattttgattttggatttatggtttttagtattgcgagatagtaatattttgttgttgaaggtgtttagtttgtggtattgtaaaatagttttaggaaattaatatagtttgttagtttatagatggtggagagatggaatgttttatggagttttaggtttattgtttgtagtttttaaagtgtgttacgggatt

SEQ ID NO: 136 - DNA, 2476 bp, Artificial Sequence
  chemically treated genomic DNA (Homo sapiens)
tgattttaggtcgataattgtaagtttttaggtagaggggaagttttagcgtcgagaagttcgtttcgagaatttttcgcgtcgggcgtttagtttgagcgtttcgggcgcggagtttattttcggtgcgggtagggttttagtcgtaggttcggcgtagggcggattcggtcgaagttcggagggtcggaggcgttgggacgtagttcggataagagggcggatttgatttcggaaagtttgtgggatttaggtattttaatattgggaagataaagagattcgatttttttgggattggtgaggggagtttggcggggaggggaacggtagggtagttaagtgtgaaagagaattttttgggtttaaagttaacgtagttattttataagttattttagaggtgatcggaaaaaataataataataaaggtgtttagtaggttgtggttgggaaggaaaaataatgtttgtaagatgagtgtgtcgattcgtagttttatattttttgtttattagttggaatatatatagatttatatatttagtaaatgtaaattttattatttaaagacgtgtttgtttcggttataattgttttaagtgtttataggttaattttatatatggaatatttcgaaagtgggtgatttgatttttaagtttaatcggtttgtgtcgtttgtcgaattgtaaattttagtaaaatttaaatatatcggaattttagtcgttttttgggagcgaggaagcgggagtaatgttaaaaggggaaaagaagaatagtaaaaaaagtataaagatattattttttgacgtaaaattacgggattttttttaaatggtataagagaatttttggagaagattattattaattaataagtaataacgttttttagggtttattagatgttttatatttgtttgggaatttcgattttttaggttttttgagaaatttatttgtttggaagaagttgtatttcgtcgttataggagtcgtcgagagttagggatggagattttagatttaggattttgttacgattttattgatttttaagcgttaatagaacgaaatggatatgtttattagttattataaatcgaattattttatatgagagagagaaatgtggtttaagttttatatttgttttttaaataatcgattttttttaattttgtttttaaaggttcgtggaaattagggagggggttggggagacggttttagaaataaaacgtttttttttagtacggtttttatatttagtttatttaagttgatttttgtaatttatataaagaatgggttcgggtgggtggttagtgaagattggggtgagtaagcgtttacgtcgtcgagcgtcggggaggtttaggttcgttttcgtatagaattttgtaaggagcgcgtttcgttaggtgttcggattagagggcgttgcgtttttgtaaatttcgcggtttcgatgcgttttttttaggtattattgttataataagttatatttaaaataatgtataaatagtatcgttttttaagttttttttaatagtgttttatatgtattttatgaatttttaaagttatgtatacgaattttttatcgtcgattcgtataaagttagagggatgcgtagtttttggagtcgagaattcgtagggcgtatacgttttttcgtattcgtttagagttatatattttacgtaattttattaacgtttaaatttaaatgttaaaaggtatgtacgatttgaataaagaatttattagtttagtcgagttttcggttttgggttttaaagttttcggtagtttcgtgattttttcgcggtgtagatatgtgttaagagtcgggtttgaagtattaattttgttttttcgggatttttagtatgtttttaattagagtgttaacgttcgtgtcgtcgggatttaggcggtcgtattttcggaggttttcgattagggtaaatttaagtattaaacgtaggcgaaaagagagtgcgcggggtcggaacgagggttcgggagtagttaagtttgttaggacgtgtttaggtagttagtcgtcgagttgaggagttgcggtcgtcggttgcggcgattcgttgtttttttttttatttttttttttttggaggcggtgggggaggggaggtgacgttagcgtttcgtttcgtttttcgtttcgggcgcggacgggatttttcggttgggcgcgttatttcgatagtggtagtagcggtcgtggaggttgcgggggtttcggtttttgcggtttttttggtcggtcgtagttgtggcgcgggtgaaacgttcgtttttttttttcggttgcgtttttcgggcgtcggcgagcgcgggcgtttttcgtatttagcgtttggagtcgtttggagtttcgttgcgcgtattttttcggttcgcggagttttttcggcggcgttttttacgtcgcggatt

SEQ ID NO: 137 - DNA, 2476 bp, Artificial Sequence
  chemically treated genomic DNA (Homo sapiens)
agttcgcggcgtgggaaacgtcgtcggaggggtttcgcgagtcggggaagtgcgcgtagcggggttttaggcggttttaggcgttgagtgcgaggaacgttcgcgttcgtcggcgttcgggagacgtagtcgaaggaggagggcgggcgttttattcgcgttatagttgcggtcggttagagagatcgtagaggtcgggattttcgtagtttttacggtcgttgttgttattgtcggggtggcgcgtttagtcggagaatttcgttcgcgttcggggcggggggcgaggcggggcgttgacgttatttttttttttttatcgtttttaagggggagggagtggggaaagaggtagcgagtcgtcgtagtcggcggtcgtaattttttaattcggcggttggttgtttgggtacgttttgataaatttggttgttttcgggttttcgtttcggtttcgcgtatttttttttcgtttgcgtttggtgtttaagtttgttttggtcggaagttttcggagatgcggtcgtttgggtttcggcggtacggacgttggtattttggttagggatatgttgaagatttcggggaggtaaagttggtattttaaattcggtttttaatatatatttatatcgcgaggggattacggagttgtcgaggattttagagtttagggtcgaggattcggttagattggtgagttttttgtttaaatcgtgtatgttttttggtatttaagtttaaacgttaatgaaattacgtggggtgtgtggttttaagcgagtgcggggaagcgtgtgcgttttacgggttttcggttttaggagttgcgtatttttttggttttgtgcggatcggcgatgaaagattcgtatgtatagttttgggagtttataaaatatatatagagtattgttaaaaagaatttgagaggcgatgttgtttgtgtattattttgaatgtaatttattatagtaatggtgtttagggagggcgtatcggggtcgcgagatttgtaggggcgtagcgttttttagttcgggtatttggcgaggcgcgttttttgtagggttttgtgcggaggcgaatttggattttttcggcgttcggcgacgtgggcgtttgtttattttagtttttattgattatttattcgggtttattttttatatgagttataaaaattagtttgggtggattggatgtagaggtcgtgttggaggaaagcgttttgtttttggaatcgtttttttaattttttttttaatttttacgagtttttggggatagggttagggagggtcgattatttaaaggataaatgtggaatttgaattatattttttttttttatataaaataattcgatttgtggtagttaataggtatgtttatttcgttttgttggcgtttaaggattagtagaatcgtggtagagttttaagtttgaaatttttatttttggttttcggcggtttttgtggcgacgaagtgtaattttttttaggtagatagattttttagggagtttggaaaatcgggatttttagatagatgtaaaatatttagtaagttttaggaagcgttattatttattaattaatggtaattttttttaggaatttttttgtgttatttaaaaaaaatttcgtgattttacgttagggaatggtatttttgtattttttttattgttttttttttttttttttagtattattttcgttttttcgtttttaggaaacggttggagtttcggtgtgtttgggttttgttgagatttataattcggtaagcggtataagtcggttgggtttggagattaggttatttattttcgaggtgttttatgtatgaaattgatttgtaagtatttggagtaattatggtcgggataaatacgtttttggatgatggagtttgtatttgttggatgtgtgaatttatgtgtattttaattggtgggtagggaatatagggttacgaatcggtatatttattttgtaggtattattttttttttttagttataatttgttagatatttttattattattatttttttcggttatttttaagatggtttataaggtgattgcgttaattttgaatttaggaaatttttttttatatttgattgttttgtcgttttttttttcgttaagttttttttattagttttagggaaatcggatttttttgtttttttagtgttaaaatgtttgagttttataaatttttcgagattaagttcgtttttttgttcgggttgcgttttagcgttttcggtttttcgggtttcggtcgagttcgttttgcgtcgagtttgcggttggagttttgttcgtatcggggatgggtttcgcgttcgggacgtttaggttgggcgttcggcgcggggagttttcggagcgggtttttcggcgttggggttttttttttgtttaggaatttgtagttgtcggtttggggtta

SEQ ID NO: 138 - DNA, 2520 bp, Artificial Sequence
  chemically treated genomic DNA (Homo sapiens)
gtttttggcgcgtagcgatttagagatcgtttacgaggttatttaggatgtgtacggttcgtcgcgggaggagagcggggaataggggtggcgcgttggggatcgcgttcgtacggagtcggggcgcgaggagatttgtttcgtttagcgtcgggtacgatgtttatttttgtttgaagatttggaatgagttttttttttttaatcgcgaaacgggagcggtgtaagtttttagttttttatttgcgatttttaagttttaaagttgtttggaagtttagaagtttttcgtaatttaattggtggtaaaattgcgtttgaattgatgtgaggttgttgatggtttttatttgttaaatttgtgtgaatatttatgttttgttgtagaaatgtaaatgagttcgatgatcggttgttgttttaagttttgttgggaggttatgtgatttatagtaggtgtgtgttttatagtttttttttaagttttagttgttttgtatttcgaagcgtatttgggtacggaacgggggattgcgggtttgtcgtcggtttaatagttttgttagttttttaggagtttggggttagatgagagggtggatgtgaaatttaggcgtttgtttttttttgagggtgtttttaatattttagatgggtttgtttgggtgtttttaatattgatgggtttgttttagaaaggcgttcggttatggtgaggttgttttttttttttttttagaattcggttgtgttaattagggaaatcgaaaataaagtacgttttaaaaatacgtttatatttttagaatattttgggcgattttgatattttgaattttaggaattttttaaggaggggtagttcgagtgggaaaaagagatgtttagaatcgtttttttatttgttattagttgtgtgatgatttaggggtagtttttttttttttttagggtttcggtttgttttttagtttaaagggaggggatggatagatgatcgttgaattttgggagtttttgatttttttcgttgtgtttgatgttattattatgaatattgatgtttattatgtgttaggattgagttcgggatgtttaaacgaagagatacgttttcgtaggttcgttgttggatgtttttttcgttcgattcgttataatgtagagtttaggtttcgagattagggaaagggtaattggattttgttgggttatttgttagttgttgatagttatttaatttatacgcgaggacgtttttttaggtttagcgttttttggtgtaagtataatatttaaggattagggttgtgagttttaaacgaggtaaggtttttaagtatttggtagtagtagggggtttatttagattgttcgggtcgttttggtttggtttttttaggattgtgtcgtttttattcgagtttttgtagcggtagttcgtcgttttgtggttagggtggaaaacggtattcggcggatagggtaggagattacggttgttttttgtttcgcgtttttgttagttagtaggtagtttttttgggatggatggttggatgttagcgtttttttttcgtagcgttttttcgttttttgtttaggttttcggtggcgtatttttcggtttttttatattttttgttttgtaggagggtttttgttcgtttgagcggagtttttggaggtgggggaatggttttattttttgaatttcgtattcggtttagggtttggtttagatagagtgtatagagtgtgtgttgaggagggcgtaggtgcggtagttttttatttatgagttaggtttttgtaggtttgtttaagggttattattaggttttaggattaaagaggaaggagattgtttaggttttgatattttttgagaagatagatgattttggttgttagggcgtttgttaggtggtttttttgtttattttttttttagtttttagtaggtttttagttgtagtggtatatggggggaggggtataggtgatgagggtaggggatttattcggggggaattaggatattggttagagataggttgttttttggttttatttgtggttttaatttattgtgtgatttttataagttattttgtatttttggttttgttttttattttgtgtaatgtgttgttgtattttagtttggatgatagagtaagatttttttttttaaaaaaaaaattttaatttagttttaatttatttttcgaggagagttatgtatttggtaattttggtattgttgtatgtaagagaaaattagaaaggaagtgatagaggtttttaaaatattgttatataaatgagttattaattgaatttttataattggttaatgagttttagtatttagaattatcgaattttatagagatgaattgtttttttaaaagattatgtgtttttaaatttatgtttaatgagtcgattattttatgagggtgttaggtgatatagtgaagattatatatgtatagagtgatagaacgttggtag

SEQ ID NO: 139 - DNA, 2520 bp, Artificial Sequence
  chemically treated genomic DNA (Homo sapiens)
ttgttagcgttttattattttgtgtatatgtggtttttattatgttatttggtatttttatgaaataatcggtttattgaatatgagtttaaaaatatatgattttttaaaagagtagtttatttttatagaattcggtgattttaaatattaaagtttattagttagttgtaaaaatttaattaatagtttatttatgtgatagtgttttggaagtttttattattttttttttggtttttttttatatgtaataatgttaaggttattagatatatgatttttttcgagaagtgaattagaattgaattaagattttttttttaagagagagaattttgttttgttatttaggttggagtgtaatagtatattgtatagggtaggaaataggattagagatgtaaagtgatttgtggaggttatatagtgaattagggttataagtggggttaaggagtagtttgtttttggttaatgttttagtttttttcgggtaagttttttgtttttattatttgtgtttttttttttatatgttattgtaattgggaatttgttgggagttggaggaaggatgggtagaggggttatttggtaggcgttttggtagttagggttatttgtttttttaggagatgttaggatttgggtagttttttttttttttggttttggggtttggtggtggtttttgggtagatttatagaggtttggtttataggtaaggggttgtcgtatttgcgttttttttagtatatattttgtgtattttgtttgagttagattttgggtcggatgcgaggtttaaagaataaggttatttttttatttttaggggtttcgtttagacgggtaggaatttttttataggatagagaatgtggagaggtcgggaagtgcgttatcgggagtttgggtaggaaacggaggggcgttgcgggggaagagcgttggtatttagttatttattttagagaagttgtttgttggttggtaggggcgcgaaataggaaatagtcgtggttttttgttttgttcgtcgggtgtcgttttttattttggttataaggcggcgggttgtcgttgtaggagttcgagtgaaagcggtatagttttaaggaagttaaattaggacgattcggatagtttgggtggattttttgttgttgttaagtgtttagaagttttatttcgtttagggtttataattttaatttttaggtattgtgtttatattagaggacgttgggtttgggggagcgttttcgcgtgtaagttaagtggttgttagtaattggtaggtgatttagtagagtttagttgttttttttttagtttcgaaatttgagttttgtattgtaacgagtcgagcggagggaatatttagtagcgggtttacggaggcgtgttttttcgtttgggtatttcggatttagttttggtatatggtgggtattagtgtttatggtaatgatattaggtatagcgaaagaaattagaggtttttaaggtttagcggttatttgtttattttttttttttgggttaaagaataaatcgagattttgagagaggaagggaattgtttttagattattatatagttggtggtagatgaaagaacggttttgagtattttttttttttattcgggttgtttttttttgaaaagtttttaaagtttaaaatgttagggtcgtttagagtgttttgaggatgtaagcgtgtttttaaaacgtgttttattttcgatttttttgattaatataatcggattttgaagagagaaaaaaaataattttattataatcggacgtttttttgaaataaatttattaatgttggaagtatttaaataaatttatttgaaatgttggaagtatttttaaagggaagtagacgtttgagttttatatttatttttttatttgattttaggtttttgggagattggtaaggttgttgagtcggcggtaagttcgtaatttttcgtttcgtgtttagatgcgtttcggaatatagaatagttgggatttggaaagagattatggggtatatatttgttgtaggttatataattttttagtagggtttggggtagtagtcggttatcgagtttatttgtatttttgtagtaaaatatgaatatttatataagtttgataaataaagattattaatagttttatattagtttaagcgtaattttgttattaattggattacgaaaaatttttgggtttttaggtagttttggagtttgggaatcgtagatgagggattaggggtttgtatcgttttcgtttcgcggttggggagagggagtttattttaagtttttagatagaggtgggtatcgtgttcgacgttgagcggagtaggttttttcgcgtttcggtttcgtgcgggcgcggtttttagcgcgttatttttgtttttcgtttttttttcgcggcgggtcgtgtatattttggatggtttcgtagacggtttttgagtcgttgcgcgttaggggt

SEQ ID NO: 140 - DNA, 2555 bp, Artificial Sequence
  chemically treated genomic DNA (Homo sapiens)
aggatagaaatgagttgggaatttgggtagtttattattttttgtatttatagaggcgggattgcggattttggttgggtagatattttagaggagtttgatagttttttagatgcggatagtaagtgtttattgtggtattggtttttttgtgtttttgggtttagagttttttttttttttttttttttttttcgtaggaagttttattatttaaaattgtttgtttaataattattattaagatgttatttttgagggagtatatatagtaggtgtttaataaatatttaataaatgaaggtattttttgaatgatttatttatttagtaaggagtttttgggtatttattttgtattaggtatttaattaggttttggagagaggaaatttaaggagtttaggtttaatgagattgacgtatacgttagttatttaataaaaagcggtgcgtgtagtggaagaaggtgtttgggagtaaagaggaggtagtttttattttagttgagttttttagttaaggggttggggtttgtaagtatagggagtagtgcgtgcgggagttaggggtttttagaaattgtttagaaattcgtgagggggttaggacgaagtttagagttagatatttatgtttagtaagttagttggtttataatttgttttttttttgtatgaatttttaagggggtgtagatggagagtgttagcgatttcgcgttttttataggttgagtttaaattttcggggttatgaatggggtttgagaagttttgggggtgggattggtttatgtagattttcgtttttgtttttgtatttgttagttagagttagggttttagggtttgtgggggggattataaaatatacggtcggagtaattagtttgtttttagcgttgtttatgagtttttagtttttttcgttgtttttttgtagggtgtagttgtagtttcgcgagattaggttttggcgggggtaggttggatagttaggatttcggtagggtttgagggtttgggagttcggttgttattttagttttcgatttttggatttggggagtttcggtttattatttggatttttttcgtagagtggggaggggtatgtaggagaagtatatgtgttgaggttgtcggtttagtaatttatttttatttttttttggggaatttttttttttaatttttagtttttgtggtttttttttttttatttttaagttttagatggatatgtgatttggatttggttaatgattggtattcgttagttatagttattggtatagggtggattttggtattttttggttatagtgattggtgtaggatggatacgtgatttatagtgagttaatgagaatttggtttgggatttttgaggagggattggggttgttaagttggtggaatataaggttagggtagtcgaggtgggggcggtataggggtgttagttggtttgtattaggggaagggttggtagagtgatattaattacggagataggtataggtttttgagaacggcgtttgaggttcgggatttaattatgttattttaaaaattttgtagtgatgtgaatagaggagttggttttacgtatttgtttttttttaaagttatagagtgtttttacggggatgggtttgagcggagtttttcggcggtatttgaggggtattatttgttggtttcgtttttgtagtttttgtattacgtttttatatttgtttagtatttttttttggttttggagagaacggggttaggggtttaggtgagattaatagttttttttttggtgggaggacgtagagtaggggttggatttagtaggtggggtgttgtggaggggtttgtatagggttgagggtaggtatggtgtagaggggtttttcgtttttcgggttagtaggggttttgggttatcgtttatatttagttttcgtagtagtagtttaatttggtatcggtttttgaagttagggttatatttttggtttaggttcgagtttattttgcgtagtagtttttgagcgttttttacgttttcgtgaaattaggggagaaggtggttttgttatagttaggaaattattagaagtatttgggtttttgtcggaggttttaagtttattttttaggcggggttgggttttcggtttatttggagtttagtatgggattttgtgttgagtttgaggtttttttgcgtggagatagttttattttttttgagttggttttttaggggttttattgggaaaagttaggtttttttttatttatttatgagatgttatttttgtgatatgtttttttggatgtattagtaagttttgaggtgtttttgatttagtttttttttttgtattaggaatatttagatttaatattatagtttttttttaggttttgataatagttttttttttttgttttcgaaaatttttttgtttattttttagtttattaatttttggtttattgttagttattttttgggttgagtatttgggttgtagttataaataggatttg

SEQ ID NO: 141 - DNA, 2555 bp, Artificial Sequence
  chemically treated genomic DNA (Homo sapiens)
taggttttgtttatggttgtagtttaggtgtttagtttaggggatagttgatagtgaattaagagttgatagattgaagaatgggtaagagaattttcgagaataaaaaggggaggttattattaaaatttagaaagaagttatagtattaagtttggatgtttttagtatagagagaggaattgaattaaagatattttaagatttattgatatatttaagaaaatatgttatagaggtggtattttatggatgggtgggaagggatttggttttttttagtgaggtttttaaggagttagtttagggagggtggggttgtttttacgtagaggagttttaggtttagtatagggttttatgttggattttaggtgaatcggaggtttagtttcgtttgagggatgagtttgaagttttcgatagaagtttaggtgtttttagtggttttttggttgtaatagagttatttttttttttagttttacgaagacgtgaaggacgtttaggagttgttgcgtaaggtggattcggatttgaattagaagtatggttttgattttaaggatcggtattagattgagttgttgttgcgggagttggatgtgagcgatggtttaggatttttgttggttcggggggcgggggatttttttatattatgtttgtttttagttttgtataggtttttttatagtattttatttgttgaatttagtttttgttttgcgtttttttattagggggaaggttgttggttttatttgggtttttgatttcgttttttttaggattaggagaaggtgttggataagtatgaggacgtggtgtaggggttgtagaagcgaggttagtaggtggtgttttttaagtatcgtcgggagatttcgtttaagtttattttcgtggaggtattttgtgattttgagggggagtaggtgcgtggggttagtttttttgtttatattattataaagtttttggggtaatatggttggatttcgggttttaggcgtcgtttttaggagtttgtgtttgttttcgtggttggtgttattttgttaattttttttttggtgtaggttaattggtatttttatgtcgtttttatttcggttgttttggttttgtgttttattagtttagtaattttagtttttttttagaagttttaggttaggtttttattggtttattgtgagttacgtgtttattttatattaattattgtggttagggaatgttagggtttattttatattaatgattgtggttggcgaatgttagttattggttaggtttaagttatatgtttatttggagtttgggaatggagaaggagagattatagggattgggaattgggagggaaggttttttaaagggaaatggaggtgggttgttgggtcggtagttttaatatatgtgttttttttgtatgtttttttttattttacggggagggtttaagtgatgagtcggggttttttaggtttaagagtcgggggttgagatggtaatcgggtttttaggtttttaggttttgtcgggattttgattgtttagtttgttttcgttagggtttgatttcgcggggttatagttatattttgtagaagaataacggggagagttgggagtttatggatagcgttgggaataagttgattgtttcggtcgtgtgttttgtgattttttttatagattttgaggttttggttttggttgataggtataagggtaaaggcgggagtttgtatggattagttttatttttagggttttttaggttttatttatagtttcggggatttggatttagtttgtggggagcgcggggtcgttgatattttttatttgtatttttttggaagtttatgtaggagaggggtagattgtgggttagttgatttgttaaatatgaatgtttagttttgggtttcgttttggtttttttacgagtttttaagtagtttttaagggtttttgattttcgtacgtattgttttttgtatttgtagattttagttttttggttggaggatttagttgggataagggttgttttttttttgtttttaggtatttttttttattgtacgtatcgttttttattaagtgattagcgtatgcgttagttttattgggtttgggttttttgaattttttttttttagggtttagttaagtatttggtataaagtaggtgtttaggaattttttgttgaatgagtggattatttaaggaatgtttttatttattaagtatttattgagtatttattgtgtatgtttttttagaagtaatattttggtggtgattattggatagataattttaggtagtgagattttttacgaaagaggagggaaggagggagaagagttttgagtttaggagtatagaaaggttagtgttatagtgagtatttgttgttcgtatttaaggagttgttaggtttttttggggtgtttgtttagttagagttcgtagtttcgtttttgtgggtgtagggggtggtgggttgtttaggtttttagtttatttttgtttt

SEQ ID NO: 142 - DNA, 2516 bp, Artificial Sequence
  chemically treated genomic DNA (Homo sapiens)
tttaataaaatatttgtaaattaaatttagtagtttattaaaaagtgaatttattataattaagtaggttttaattttaggatgtaagtttggtttaatatacgtaaattaataaatgtgatttattatataaaattaaagataaaagttatattattattttaatggatgtataagaggttttcgataaaatttaatattttttattaaaaatttttaataaattaggtattaaagaaatatattttaatatatatgtgataaatttatagttaacgttatattaaatgggtaaatgttggaaatattttttttgaaaattagtataagataagggtgtttttttttattatttttatttaatatagtattgtaagttttggttagggtaattaagaaagaataaaatgaagggtatttaaataggaagagaggaagttaaattatttttgtttgtagatgatgtgattttgtatttagaaaattttatagttttggtttaaaagtttttttaggtgataaataattttagtaaagttttgggatataagattaatgtaaaaaattattggtatttttatatgttaataatggttaagtttagagttaaattaggaatgaaattttatttatgattgttataaaaagaataaaatgtttaggaatatagttaattagggaggtgaaagatttttataatgagaattgtaaaaatattatttaaagaaattagagatgttagtagttagtttagttcgtttgttcgttcgtagtcgtttgttagatacgtttagtatgagggagattttgtatatttaggtcggttagtgcggtaattagatcggggttaagttttgggaagttattagtgatgagtatggtatagattttagcggtaattacgtggggaattcggatttggagttggagtagattagtatttattataacgaggtttttttttataagtatgtgtttcgggttattcgtcgatttggagttcgggattatggatagtgtcggttcggggttttttggatatttttttaggtttgataatttaatttttggttagagtggggtcggtaataattgggttaggggttattatacggagggtgcggagttggtggatttttttttggatgtgcggaagaagtgtgagaattgcgacggtttgtagggtttttagttgattttttcgttgggcgggggtataagttcgggtatgggtacgttgtttattagtaagatgtatgaggagtattttaattgtattatgaatatttttagcgtagtgttttcgtttaaggtgttattgtggtggagttttataattttatgttgtttatttattagttggtggagaatatagatgagatttattgtattaataaggaggcgttttaggatatttgcgttagtatttttaggttggttacgtttatttacggggattttagttatttgatattggttattatgagtaggattattatttttttgtgtttttcgggttagtttaatgcggatttgtataagttggtggtgaatatgggtgttttttttttgtttgtatttttttatgttaggtatgaagttcgggtagttagtattatcgggttttgatcgtgttcgagtttattttttagatgtttgatgttaagaatatgatggttgttcgcgatcggtattacggttgttatttggtagtggttatcgtgtttcggggttgtttgtttatgaaggaggtggacgagtagatgttgtttatttagagtaagaatagtagttatttcgtggagtggatttttaataatatgaaggtggacgtgtgtgatattttattttttagttttaagatgttttttatttttattagtaatagtacgggtatttaggagttgtttaagtattttagagtagtttacggatatgttttagtataaggtttttttatattggtatatgggtaagggtatggacgagatggagattatcgaggttaagagtaatatgaatgatttggtgttcgagtattagtagtattaggattttatggtttaggaggagggtgagatgttcgtagatgaggaggaggaattggaggtttagggttttaagtgaagttgtttgtagttggagtgaggggtaggtggcgtcggtgttaaggttagtagtgtttgatttttagagttattttgttgtcgatattgtttttagtttttttttattagtttgttatttacgttagggtttttttgttatttttttgtagtgtttatattcgttttttttatttaggttacgtgtgtgttgtttttgtttttgttttattgtagttttaggtttgatattttatggatttgttttttattggtttgtgtttatatttttagggatatttaataaatttattgttgttagataaaaaaaaaaagaaattagagatgatataaagaaatgaaaatatattttatgtttatggataggaagatttaatattattaaaatgg

SEQ ID NO: 143 - DNA, 2516 bp, Artificial Sequence
  chemically treated genomic DNA (Homo sapiens)
ttattttaatgatattgagtttttttatttatgagtatgaaatgtatttttatttttttgtgttatttttgatttttttttttttttatttgatagtaatagatttattaagtatttttgaaaatataaatataaattagtaaaaaataaatttataaaatgttaggtttggagttgtaataagatagagataggagtagtatatacgtggtttaggtggggaggacgggtgtaaatattgtaggagggtggtaagggagttttagcgtgagtgataagttggtgggggaaagttggggatagtgtcgatagtaagatggttttggaggttagatattgttggttttggtatcggcgttatttgttttttattttagttgtaagtagttttatttggggttttgggtttttaattttttttttttatttgcgaatattttattttttttttgggttatggagttttggtattgttggtattcggatattaggttatttatgttgtttttggtttcggtgatttttatttcgtttatgtttttgtttatgtattagtgtaggaaggttttgtgttggaatatgttcgtgaattgttttgagatgtttgaatagtttttggatgttcgtgttgttgttgatgagggtggaagatattttgaggttggggggtgggatgttatatacgtttatttttatgttgttggggatttattttacgaagtagttgttgtttttgttttggatggatagtatttgttcgtttattttttttatggataggtagtttcggaatacggtggttattgttaggtagtagtcgtggtgtcggtcgcgggtagttattatgtttttggtattaaatatttgaggggtgagttcgggtacggttagggttcggtaatgttggttgttcgggttttatgtttggtatgaagaagtgtaggtaggggaagggtatttatgtttattattagtttgtgtaggttcgtattgagttggttcgggaagtataaggaggtagtgattttgtttatggtggttaatgttaggtggttgaggttttcgtaggtgggcgtggttagtttgagggtgttgacgtagatgttttagagcgtttttttgttgatgtagtaggttttatttgtattttttattagttggtggatggatagtatggggttgtagggttttattatagtgatattttgggcgagggtattacgttgaaggtgtttatgatgtagttgggatattttttatgtattttgttgatgagtagcgtgtttatattcgagtttgtgttttcgtttagcgagagggttagttggaaattttatagatcgtcgtagtttttatatttttttcgtatatttaggagggaatttattagtttcgtatttttcgtgtagtgatttttggtttagttattgtcggttttattttgattaaagattaaattgttaggtttgaaaaaatgtttaaaaggtttcgagtcgatattgtttatggtttcgggttttaggtcgacgaatggttcgaggtatatatttatgagaagaggtttcgttgtagtagatgttgatttgttttagttttaagttcgagttttttacgtagttgtcgttggggtttatgttatgtttattattgatgattttttagaatttggtttcgatttagttgtcgtattggtcggtttgaatgtgtaggattttttttatattgggcgtgtttggtaggcggttgcggacgggtaggcgggttgggttggttgttgatatttttgatttttttgagtggtgtttttgtaatttttattgtagagattttttatttttttggttagttgtatttttaggtattttattttttttgtggtaattatgaatgggattttatttttgatttggttttaggtttgattattgttggtatataggaatgttagtgattttttatattgattttgtattttaaaattttgttgaagttgtttattatttgaaggagtttttgggttaaaattatggggttttttagatatagaattatattatttgtaaataagaatagtttgattttttttttttttatttggatgttttttattttgtttttttttgattgttttggttaggatttataatattatgttgaataggagtggtgagagagggtatttttgttttgtgttggtttttaaggggaatgtttttagtatttgtttatttagtatgacgttggttatgggtttgttatatatgtattgaagtgtgtttttttaatatttagtttattaagagtttttaataaggagtgttgaattttatcgaaagttttttgtgtatttattgagataataatgtggtttttgtttttagttttatgtgatgaattatatttattgatttgcgtatgttaaattaaatttgtattttgggattgaagtttatttgattgtggtggatttattttttggtgggttgttggatttggtttgtaaatattttgttgag

SEQ ID NO: 144 - DNA, 2364 bp, Artificial Sequence
  chemically treated genomic DNA (Homo sapiens)
gtaaagttggtattgttaaatagtagaggaagtatggcgtgtttaagaagtggttttgggattattagagatttttatagaaaaaaaaatgatacggatttttattttatttataagtcgtaagagttaagtttaggtgcgttataggttgaaatataaacgttaaaggtttataaggtagtttttatggtagggtaagagttttttatttttttgttggttttttgttttgttttgagatggagttttaatttgttatcgaggatggagtgtagtggtattgtgttagtttattgtaattttcgttttttgggtttaagtaatttttttgttttagttttttgagtagttgggattataggcgtttattattacgtttagttagtttttatatttttagtagagatgggggttttattatgttagttaggttggttttaaatttttgattttaggtgatttattcgtttcggttttttaaagtgttgggattataggcgtgagttattacgttcggtttagatttttgaaacgttaataatattgataatttggttataaaattttaaaaatttttgtgtatttataaataaaaaaaattgaaaagttatagaatggaagatatttatattttttgtatattgttttttaaaaatgtattttttataaattaggaaaagatgatttaggagaaaaataggtaaaaagtttttatagatattttataggaggaaatttcgtgattaaaaaaagatgtaaataggttttatttttgttgttattaagaaattgttaatcggttgggcgcggtggtttatatttgtaattttagtattttgggaggtcgaggtgggtggattacgaggttaggagtttaagattagttaggttaatatagtgaaatgttgtttttattaaaaatataaaaattagtcgggtatggtggcgtgtatttgtaattttagtaatttaggaggttgaggtaggagaagtatttgaattcgggaggtggaggttgtagtgagtcgagatcgtgttattgtattttagtttgggtgatagagtgagattgttttaaaaaaaaaaatgttaatcgaaggtattgggtagcgtgtggtgtgttttaaatgttaacgttatatagaggagttttagtttggtacgtttgttgtttataaaaggagaggcgttttgtttttttgattatttaaagaagttttatgaattaataggaaaaaagtttatttaattaatataattttattaaaagtgggttagggaagtgaacggaaattttttagaagtagtagcgtgttaggtttatttttatttgaaaatataagttaatttttttagtgttcgggaaaggaatagagaaagtagtgataatttatattatatttattagtttaggaaaagtttaattttggggttttgagaattttatacgggtttagtatattttagttttcggttcgtgtttttaggatataggtttggggttggagataggtttagtagcgtagtggcggtgtcgggaggggtttgggatagggtaagttttgggtagatatttttttatttgttgagattcgagtacgtttaggtttgttttataagttatgcggggaggatttcgagttatttttaggtcgtcgattttattttagttgggtagatagtttttttttttttgttatttttttaaatagtcgttttattttcgtgagttttattgaggtttagatatatatttttattagtgtcgtatatattttaatatttttgaaagtagattattttaatattaatagcgtggtatagtttgatgggtagtattttttggtggtataaaatgatgatgtattttaaaatgaaggatattttagatttcgtgaaatattaagttgttagtggatgttgttatttttatttgtttgtgtattggtcggtttgtaagttttaggcgggtagggttggtaagtattggcgtaaggtgtatttgtttacgcggtgatttcggtgtggggtgtagggtgtggaggtgggcgtagtgttcggagatattaatagttatgtgttgtggggaaggggtagggtagggtgggtagttttttgttttgtttttttttgtgtatttttgaattttttgtatagttgatatttttaaggaaagtatatatatatagtaagggttgtgtatgtaattaatttatttttagtgtagggtaaggaaattaattttaaaggagagattgtagtttagagttttttgtagggtatttatttggatatgtttcgggaagaggggtatcggtttttattatagttttagttaggtttgtgggaaattttttttatttt

SEQ ID NO: 145 - DNA, 2364 bp, Artificial Sequence
  chemically treated genomic DNA (Homo sapiens)
ggggtgaggagggttttttataagtttggttggggttgtggtgggggtcggtgttttttttttcggaatatatttaggtgggtgttttgtaggaagttttgggttgtagttttttttttggagttaatttttttgttttgtattggaagtgaattgattgtatatatagtttttgttatatatatatgttttttttgaaagtattagttgtgtaaagagtttagaaatgtataggagagaatagaatagaaaattgtttattttgttttgttttttttttatagtatatggttgttggtattttcggatattacgtttatttttatattttgtattttatatcggagttatcgcgtaagtaggtgtattttgcgttagtgtttattagttttgttcgtttggagtttataggtcggttagtgtataggtagatgaggatagtagtatttattgataatttggtattttacggaatttaaggtgttttttattttaagatatattattattttgtgttattaagaaatgttgtttattaaattatgttacgttgttgatgttaagatggtttgtttttaaagatgttgaagtgtgtacggtattgatgggggtgtatgtttgggttttagtggagtttacgggggtggggcggttatttgagaaagtggtaggaggagaggagttgtttgtttagttggggtggagtcgacggtttgaggatgattcggggtttttttcgtatggtttatggagtaagtttggacgtgttcgggttttagtaggtgggggagtatttgtttagagtttgttttgttttaggtttttttcggtatcgttattgcgttgttaagtttgtttttagttttaggtttgtgttttgggagtacgggtcgggggttgggatgtgttgggttcgtgtgggatttttagggttttaggattggattttttttggattggtgggtgtgatgtgggttgttattgttttttttgtttttttttcgggtattagggaggttgatttgtgtttttaaatggggatgggtttaatacgttgttgtttttgggagattttcgtttatttttttggtttatttttaatgaggttgtgttaattgggtgggttttttttttgttgatttatagaatttttttgagtgattaagaggatagggcgtttttttttttgtgagtagtagacgtgttaagttggggtttttttgtgtggcgttggtatttgagatatattatacgttgtttagtgttttcgattggtatttttttttttaagatagttttattttgttatttaggttggagtgtagtggtacgatttcggtttattgtaatttttatttttcgggtttaagtgttttttttgttttagttttttgagttgttgggattataggtgtacgttattatgttcggttaatttttgtatttttagtagagatagtattttattatgttggtttggttggttttgaatttttgatttcgtgatttatttatttcggttttttaaagtgttgggattataggtgtgagttatcgcgtttagtcgattggtagttttttgatggtaatagaagtggagtttatttatatttttttttggttacggagtttttttttgtgaagtgtttgtagaagttttttgtttgttttttttttgagttatttttttttaatttatagaagatatatttttgaaagataatatatagaaggtataaatattttttattttgtgattttttaattttttttgtttgtggatatatagaagtttttaagattttgtggttagattgttaatgttattagcgttttagaaatttaagtcgggcgtggtggtttacgtttgtaattttagtattttgggaggtcgaggcgggtggattatttgaggttaggagtttgagattagtttggttaatatggtgaaatttttatttttattaaaaatataaaaattagttgggcgtggtggtgggcgtttgtaattttagttatttaggaggttgaggtaggagaattgtttgaatttaggagacggaggttgtagtgagttgatatagtgttattgtattttattttcggtgatagattaagattttattttaaaataaaataaaaaattaataaaaaaataaaaaatttttgttttgttatggaaattattttgtaaatttttgacgtttgtattttagtttataacgtatttggatttggtttttacggtttgtgaatgaggtggaagttcgtattatttttttttttatgagaatttttaatggttttagagttattttttggatacgttatattttttttgttgtttggtagtgttagttttgt

SEQ ID NO: 146 - DNA, 2408 bp, Artificial Sequence
  chemically treated genomic DNA (Homo sapiens)
atatatgggaggtagaatttagagattgggtttaggagtttttttgttgatagtgggaatttttagttacgtgtgggggtttttatattagataaaggtttttgattttagttttgttcgagaggtcgatatagtttagttttggggtttggttttatttataagaggttatattttgttatagtattgtttatttggtttgttttagaagtatcgttagagtggcgaaggtaggaggtggtgtacgagagtttacgttttagtatttatttaagtgagggaaaggcgtttcgtatttagaaaaatgtaaaattaatgatttttatttatatatgagattgtggatttatttatgtatgagatagtggatttagagttatgttgtggtttttatttgttgggagttagtagtgtttgtgttttggttttgtttttttagttatatggtttatgtgaggtgcggatttatttgagttgttttgtttttatagggagtttgttttttttttgttggtttgtttttatttttgttgtttttgtttagaagaaaatattagaattggggtgtggtggaaggatgggagtataatttgggaggggaagatttgttttttttttatatattaggagggagtggtaggaaggggagatattgtgtcggatttagggagttaagagcgtgagtatttttaggttttaatttgttgaacgttgtgtatttgggggcgttcgtgtagtaggaatattttttttattataatttttttgggtatagtggagagttatgagtgggggttgttttgggggttgcgttatggtgagtgagtttacgttaggagttagtttagtttagttttattttttttttgtttttttgttttttaagttttagtttataagtaattagtatagtatttggaatgtaagaggcgtttggtttataaaagagagaagaaaggaattttttttattacgagggacgttaggtttagttttttgtttcgggtatttatttttttttcggtaattagttttagttttaatgatttgttgtttgttttatgttgtatttatgatttttagattgtaaagtttgtggtaaatgtattaacgtttatattttatttatagattagtaaattaaggatttgagaggttatgtgatttttttagtttggcggagggtagggttttgttagaagtcgagatatatttcgtaatagtttgttatttggggttttttattagtgaggtaggagttataatggggttttggtttttgggtaatttttataaaatattgtgttatttgaagatggaagtgttagaggaaggcgagatgttatttttgaaagtatttatttttagaaagagatagaggagtgtatcgtagttgtgtgaattcggggtggtggtggttttagtagcggggtacgtggtggacgtaagacggtttcgtttgagttttgttgttaggtgatatgtagaatttgaattttagagggtgttttttggaggttttgatgagagagatatagaagggaagggagattgtttttatggttttgtttttgcggtagcgagtttgttgtttttgtagttgggtggttgttcggtgtagggggtcggtgaggaatacggtggggagtagtttgcgagggcgtcgggtttttagtatttattatatttgttgtttggtttggttaggatggtttgggagtttttagggtcgggtaaagattgtttttaatagatatgggcggagggaatcgttttatttttgtttttttttttttttttacgtagtgttagtgggacgggagggtggtttgttcggggttttaagtttttgtttaggaatcggatttatgtcgtacgttagtgtagttatacggttagtttcgaggtgtttatggacgtttttaggtgtgagatgggtatttttttgtggttattatgttcgttgagtttatttttaaatttgtttttttttaaattaaattttttattttaagcgttttgaacgaagtaaattaattaattaaaaaaatatattttaggattggttagagtttgtgaagatttttataataaattttcgttataagggtttttagagagttttggttgtgtattaaatttcgcgatggtaaatttaaagtttaggttttgaggagtttttggagtttgtttttcgttttagagatggtttgtgcgagggtgtcgtttttttttcgttttgattataaggaaggtgatagttgttggggacggtaggtatttttttttagggttataagttgggttgtaggataaaagattgggcggttaatgtttaatttttggtattttaagcggtttgggagtgtgagtcggttattgtgggtttgtagatgaattggggagtg

SEQ ID NO: 147 - DNA, 2408 bp, Artificial Sequence
  chemically treated genomic DNA (Homo sapiens)
tattttttagtttatttgtaggtttataatggtcggtttatatttttaggtcgtttaaaatgttagaggttaaatattagtcgtttagttttttattttgtagtttagtttgtggttttgagggagagtgtttatcgtttttagtagttgttattttttttatgattaaagcgggaggagagcggtattttcgtatagattatttttgaagcgaggggtagattttaagagttttttagagtttgagttttgggtttgttatcgcggggtttaatgtataattagggttttttgaaaatttttgtaacggggatttgttatggaaatttttatagattttggttaattttggaatatatttttttaattggttgatttgtttcgtttaaagcgtttagaatggaagatttagtttgaggaggggtaggtttgggggtaggtttagcgggtatagtggttataagaagatgtttattttatatttggagacgtttatgagtatttcgaagttggtcgtgtggttgtattggcgtacgatatgggttcggtttttggataggagtttgaagtttcgggtagattattttttcgttttattgatattgcgtagagaagggagaagaggtaggggtgagacggtttttttcgtttatgtttgttgggggtagtttttgttcggttttggggatttttaggttattttggttaaattaaatagtaggtatagtgagtgttgaaagttcggcgttttcgtaggttgttttttatcgtgttttttatcggttttttgtatcgaatagttatttagttgtaagagtagtaggttcgttgtcgtagaggtaggattatgggaatagtttttttttttttttgtgttttttttattagggtttttaaggagtattttttgaagtttaagttttatatgttatttagtagtaaaatttaaacggggtcgttttgcgtttattacgtgtttcgttgttggaattattattatttcgggtttatatagttgcgatgtatttttttgtttttttttgagggtagatgtttttagaaataatatttcgtttttttttgatatttttatttttaggtggtataatgttttatgggaattgtttagaagttagggttttattatgatttttgttttattgatgggaagttttaaataataagttgttacgaggtgtgtttcggtttttgatagggttttgtttttcgttagattgggaaaattatataattttttagatttttagtttgttaatttgtaaatgggatgtgaacgttaatatatttgttataaattttataatttggaaattataggtgtaatataaagtagatagtaggttattagagttgaagttaattgtcggaaaaaagatgaatgttcgggatagagagttgggtttgacgtttttcgtggtgaaaggggtttttttttttttttttttataagttaagcgttttttatattttaggtattgtgttggttgtttatgaattagaatttggaaagtaaagaagtaggagaagaatgaggttgggttgaattggtttttggcgtgggtttatttattatagcgtagtttttaggatagtttttatttatggttttttattgtgtttagaggaattgtgatggggagagtgtttttgttgtacgggcgtttttagatgtataacgtttagtagattgaagtttgggggtgtttacgtttttgattttttgagttcggtatagtgttttttttttttgttatttttttttggtatgtggagagagagtaggttttttttttttagattgtgtttttatttttttattatattttagttttaatgtttttttttaaatagagatagtaaaagtgaaaataaattagtagagaaaaagtaagttttttgtaaagatagagtaatttaagtaagttcgtattttatataaattatgtagttaaaaaagtaaaattaaagtataaatattattggtttttagtagatgagagttatagtatggttttgaatttattattttatatatgggtgaatttatagttttatgtgtgggtgagaattattaattttgtatttttttaagtacgaaacgttttttttttatttgaatggatgttagaacgtagattttcgtgtattattttttgttttcgttattttgacggtgtttttgaaataggttagataaatagtgttgtggtaaggtgtggttttttgtgggtaaagttagattttaaagttgggttgtgtcggtttttcgggtaagattaaggttagggatttttgtttggtatggggatttttatacgtagttgggagtttttattgttagtagaagggtttttgggtttagtttttgggttttgttttttatgtgt

SEQ ID NO: 148 - DNA, 2523 bp, Artificial Sequence
  chemically treated genomic DNA (Homo sapiens)
ttcgtgttaaaggttttgtgtggttgtttttttaatttgttgggttttttttatgttattatattgttttttatttttatttttatttttttagttattttaaatttatgtataattttttttttttttttttgatagatttttattttgtggtttaggttggagtgtagtggcgtgattttggtttattgtaatttttattttttaggtttaagttatttttttgttttagttttttaagtagttgggattataggcgtttattattatgtttcgttaattttttgtatttttagtagatatggggttttattttgttggttaggttggttttaaatttttgattttaagtgatttgttttttttagttttttaaagtgttaggattataggcgtgcgttattacgtttggtttataattttttaattgttttattattatttttggtttttaagatattattgattgggtgtagtggtttatattcgtaattttagaattttgggagatcgaggtaggtggattgtttgagtttaggagttggagatagtttaggtaagttggtgagattttttttataaaaaaatagaaaacgtttattggatttggtggtattgtttatagttttagttatttgggaggttgaggtaggaggataatttgagtttaggggtttaaggttgtagtgagttatggttgtgttattgtattttagtttgggtgatagagtaagattttatttttttaaaaaaaaaatggaatattaaaaattagaagatggtgtcgtgtttgttagtttttcggggtgtgagtttattattgcgggttattttttttatggagtttaagttttagggggatatatttttacggagggtgtatgtttgtttttgttggagtttgggtggtttttaggttttggaattagattttatattttttatttcgtttattggttgttagtggtgttttattcgtgttttggtgatagaggtagcgtttcgggggtataggtatcggcgttagttttgagtttgaattttagttcggttttagttagttgtatggttgagggtgggtgggggatgtttttgttttgattttttatatttttatttatagtgtagttttattttttttataggagtcggagggttatatgggaaaataggtatggtagacgtaaaaggtttagtggaaatgtcggttttttttgttgttattattgtatttatttggtaatttcgtattataattcgagatttagaagattttatgttttaggcggggttgaataggatagatttcgaagagtcggtttttagatcggatcgttaataattaggtcggatttcgcgtttttagtcggttagtgttttggtaaggtaggagcgggtgaaatttttagtttttttagggagtagttagatgatgatatatttatattcgtttatagggagggagtgcgataaggtttgtggttttttgcgcgagaatcggttagtgttttttggggttcgggatggggttttagtatttatttttattatcggggttcgggagggagggttggagagtttttatttggtgtcgtcggtggttattttttagatagcgcgggcgggttcgtaggttttgggtaaatgtggtgttgttatagtttcgttttatagggatagcggttagtagttgtttttggtttcgtcgtttttaatgaagttatagatggtagtttttaaatgtttttagaaatggtagagaggtttttagagttgacgtgtaaataaattgttttttaggttcggattatataattttgttgggattaagtataggtttgggtttttcggttgttttttagggtttggttttgttgagaggaggaagtttggtttttgggagggggttttaggtgttttttttatggagtttagtaatttggtaggtgggggtgggtatcgtttttttttcgggattttattttttcggtaattagttgttttttttttttttggggttttaggtggtttttatggaggggtgggtgggattgaggtttgagtttcggggaggagttggttggtgagttatgtattttagtggttattgcggttagtcggggaggttgaattttaggttttagtatttagaagttggtggagtgggttgaattgagtttttttaaaaacgtatgtcgaagttttgatttcgggtatttgcgagtattggaaatggggtttttgtgaatgatcgagttaagatgaggtcggacggggagggttttaaaagtaacgatcggtattttgtaaggaggttgttgatagtagggagaagtcgggcgcgtgacgttagaggtagagattggagagaggtagtttaggaatattacgggtggttggtagtgcggagcggtagggtttttttttggaggtttcggagggagtgtggttttgcggatatttcgattttaggtttgcggttttagggttggaggggtcgcgttttcgtggttttagttttta

SEQ ID NO: 149 - DNA, 2523 bp, Artificial Sequence
  chemically treated genomic DNA (Homo sapiens)
tgggagttaaagttacggaaacgcgatttttttagttttggggtcgtaagtttgagatcgaggtgttcgtagggttatatttttttcgaagtttttaggggagggttttatcgtttcgtattgttagttattcgtggtgtttttgggttgtttttttttagtttttgtttttgacgttacgcgttcgatttttttttgttgttagtagtttttttataaggtgtcggtcgttgtttttgggatttttttcgttcgattttattttaattcgattatttataaagattttatttttagtgttcgtaggtattcggggttagggtttcgatatacgtttttggaggggtttaatttaatttattttattagtttttgagtgttggggtttgggatttaattttttcggttggtcgtagtgattattgggatatatggtttattagttagttttttttcggggtttaggttttagttttatttatttttttatgaggattatttggggttttagagaagggagaggtagttgattgtcggggagatggagtttcgggggaggggcggtgtttatttttatttgttaggttgttgggttttatggagggggtatttgagatttttttttaagagttaggttttttttttttagtagagttaggttttgaggggtagtcggagggtttaggtttgtgtttggttttagtagaattgtgtggttcgagtttgagaagtaatttatttgtacgttagttttgggagtttttttgttatttttggagatatttaagagttgttatttataattttattagggacggcggggttaggggtagttgttgatcgttgtttttgtagggcggggttgtggtaatattatatttgtttagggtttgcgaattcgttcgcgttgtttgaggagtggttatcgacggtattagatggaggttttttagttttttttttcgagtttcggtagtgagagtgggtgttgaaattttatttcgggttttaaaggatattggtcgattttcgcgtagaaagttataggttttgtcgtattttttttttgtggacgggtgtggatgtgttattatttgattgttttttgggagggttgggagttttattcgtttttgttttgttaaggtattgatcggttggaggcgcggaattcggtttggttgttggcggttcgatttggggatcggtttttcgaggtttgttttgtttagtttcgtttggggtatagggttttttaggtttcgggttgtggtgcggggttgttagataaatgtagtaatggtagtaaggagaatcggtatttttattgggttttttacgtttattatgtttgtttttttatgtggtttttcgatttttgtgagggaggtgaggttgtattataggtgaggatgtgggggattaaggtaggggtattttttatttatttttagttatgtagttgattggggtcgggttggggtttagatttaaagttgacgtcggtgtttgtattttcggggcgttgtttttgttattaggatacggatggggtattattggtagttagtgggcggggtgggggatatggagtttggttttaggatttagaggttatttaggttttagtaaaggtaaatatgtatttttcgtggggatatgtttttttggggtttgggttttatagaagaaatggttcgtaatggtgagtttatatttcgagggattggtagatacggtattattttttaatttttaatgttttattttttttttaaagagatgaagttttgttttgttatttaggttggaatatagtggtataattatagtttattgtagttttggatttttaggtttaagttatttttttgttttagttttttaagtagttgggattataggtagtgttattaagtttaataaacgttttttgtttttttgtagaaagagttttattagtttgtttaggttgtttttagtttttgggtttaagtagtttatttgtttcggttttttagagttttaagattacgggtgtgagttattgtatttagttaatagtattttaagaattagaaataataatagaataattaagagattataggttaggcgtggtggcgtacgtttgtaattttagtattttgggaggttgaggagggtagattatttgaggttaggagtttgagattagtttggttaataaggtgaaattttatgtttattaaaaatataaaaaattagcgggatatggtggtgggcgtttgtaattttagttatttgggaagttgaagtaggagaatggtttgaatttgggaggtggaggttgtagtgagttaagattacgttattgtattttagtttgggttatagagtgagaatttgttaaaaaaaaaaaaaaaagattatatatgagtttaaaatgattaaagagataaaagtagaaatgaaaaataatataatagtatgaaaaggatttagtagattagaaaaataattatataggatttttaatacgag

SEQ ID NO: 150 - DNA, 2280 bp, Artificial Sequence
  chemically treated genomic DNA (Homo sapiens)
tattgttttgtttgttttgagaatagtatttaacgcgattgtgttttcgtagtagacgttaggtcgttgtttacgttttgagtgtcggacgaggttaatataggtttttcgttatagaatatgtttgggtaggaagatcggaatatttggggttgggtatttatcgtttttttacggtatatacgagtcgttagggaaatgttcgtttttgtgtgtgttgtacgtgtagttttttgggtagagtcgtggagagttggacgtaggttaggtgtgaggaggagaggtgtgtttggggtggttattggttttttttttgcgtgacgtaggttggcgtgggttttttttttagttttttgtcggtgttgttacgtgagaagggttcgggtgtcggtttcgttatttcggaattgtgggtttatttgaagtttgaggttaaatttttagcggttagtgggacgttagtcgtttttgattttttggttaagttggttttgtcgtgattcgtgagaatgtttaagtgttaatgtgtttcggggggtagggtcggggttgggattttagtgtgtgtttagtttttttttcgtttttgcgggttttattatttttttattttaacgtatcgttagggatgcggttaggtcgggtttatttttagggcggtttaaggggatcgttttttggtttgttaggaaggtaggttagtaagaagggtttcgtcgagttttatttgttaaggatagggtttcgtaggtgggttagggttggtttaaagcggtcgagatgttgattcgttatgtgcggggcgttgttggcgttttttttttagtaaagggcggagggagtggacgtgggggaagggtaggtgggtatttttggagtaatattgttattaagaggaattggtttggtaatttcgcgtatttttcgttgtgttcgtttggggaggagtggtttgggattgttttgggggattaggtaggattagggtaggtgttcggacggattcgaggtttttggaggttcgagagaagtaggtttcgtcgcggggtcgggcggtggaagttttagagagaggcgttaggattagttggatagttaggacgtcgggtcgttttcggataggaagttacggttcgggagtttggtggcggttatgatttgggcgggattagcggaggttttcgttagggagtttgggttcggggttttgggtagtttgtttggtgttttttttcgtgggagtaatcggggtgacggtttagttgggttttcggttcgggaggtttcgtcggttatattgtacgtttgcggtgtgaggagggtcgattgttagtgttgagtttcgtggttattggcgcgggtgttcgtcgttgttggtcggcgtcggggcgtttttttttgcgttttagggaggaaggtgggtcgcggggtatttcgcggggttcgtatttagacggtttttgacgaggtggacgtaaggttaggttcggttcggttcggttcggttcggttatttttagacgtcgcgtattcgttttgttgagatttgttattttgttttgttgtgtttatgttttcgaggttgttttggaggcgggtcgtttttcgtggtgtttatttttgtttgggggtttttcggggatttcgtttgtttttgggggtgcgtaggtttttgttttgcgattagaggcgtatcgatcgatgagttcggtggtaaagtttgagaaatggagattttttgggtatcggttaagggggttcggggtttttttaggtttgttggagttcgggaagtcgggggtatttagaaggaaggattcgtcggattttgtttggggatagtttgtttcgcgttagaagggttcgttgtttaggtagtattttcgtgttttttttttagtgggttttttaggtagaatcggggtaggttttattggacgtgtagggaggaggttcggaggatgtattttttgtaggattcggtttggtatagtagtagacggagttatttttcggggttttttggttttttcgagggtgtttaggagttttttaagtgcgtaggggttcgtgtttaaagggtggaggtcggtatcgtttcgtttaatttaggagtggagaaggaagttagaggattttttggaggtggtaggtttaatgttttgtttttttatttatttatttatttatttatttatttatttattttgtaattaattgaaagaaggtagaaggagtcgatgggttttttaggtcggaaattttataagtattaggatt

SEQ ID NO: 151 - DNA, 2280 bp, Artificial Sequence
  chemically treated genomic DNA (Homo sapiens)
ggttttaatgtttgtaaggttttcggtttaagaggtttatcgattttttttgtttttttttagttgattataaaataaataaataaataaataaataaataaataaataaaaaagtaggatattaaatttgttatttttagagggttttttagtttttttttttatttttgaattgagcgaagcggtgtcgatttttattttttgggtacgagtttttgcgtatttgggagatttttgaatattttcggagaagttagaaagtttcgggagatggtttcgtttgttgttgtattagatcgggttttgtaaaggatgtatttttcgagttttttttttgtacgtttagtggggtttgtttcgattttatttgagggatttattggaggagaggtacggggatgttgtttgagtagcggatttttttggcgcggagtaggttgtttttaggtagagttcgacgggtttttttttttgggtgttttcggtttttcggattttagtaggtttgggaaggtttcgggtttttttagtcgatgtttagagagtttttattttttaagttttgttatcgaatttatcggtcggtgcgtttttgatcgtagggtaagggtttgcgtatttttaaagataagcggggttttcggaaggtttttaggtagaaatgagtattacggggaacggttcgtttttaagataatttcggggatatggatataataagatagggtggtaagttttaataaggcgggtgcgcggcgtttgaaggtggtcgggtcgggtcgggtcgggtcgggtttggttttgcgtttatttcgttaagaatcgtttgggtacgggtttcgcgggatgtttcgcggtttatttttttttttaggacgtaaggaggaacgtttcggcgtcggttagtagcggcgggtattcgcgttaatggttacggaatttagtattggtagtcggttttttttatatcgtaggcgtgtagtgtggtcgacggagtttttcgggtcgaggatttagttaggtcgttatttcggttgtttttacgggaaggggtattaggtaaattgtttaaggtttcgagtttaggttttttggcggaggttttcgttggtttcgtttagattatggtcgttattaggttttcgagtcgtggttttttgttcgggaacggttcggcgttttggttgtttagttagttttggcgtttttttttggggtttttatcgttcgatttcgcggcggagtttgtttttttcggatttttagagatttcggattcgttcgagtatttgttttagttttgtttggttttttaggatagttttaagttatttttttttaggcgagtatagcgaagggtgcgcgggattgttaagttagttttttttgatggtagtattgttttagaaatgtttatttgttttttttttacgtttatttttttcgttttttgttgaggaaaaaacgttaatagcgtttcgtatatggcggattagtatttcggtcgttttgggttagttttggtttatttgcgggattttgtttttggtagatgggattcggcgggattttttttattagtttgtttttttgataaattagaaagcggtttttttggatcgttttggggatggattcgatttaatcgtatttttaacgatgcgttaggatgggaggatggtggaattcgtagggacgagaaggagattgggtatatattaggattttagtttcggttttgtttttcgggatatattggtatttgggtatttttacgggttacggtaaggttagtttgattaagaggttaaaggcgattggcgttttattgatcgttgggggtttggttttaaattttaggtgaatttataatttcggaatagcgggatcggtattcgggttttttttacgtggtagtatcggtaaggggttgggggaagagtttacgttagtttacgttacgtaggaagggagttagtggttattttaaatatattttttttttttatatttggtttacgtttaattttttacggttttgtttagaaggttgtacgtataatatatatagaggcgggtatttttttgacgattcgtgtgtgtcgtgggggagcggtagatgtttagttttaagtgtttcgatttttttgtttaaatatattttgtgacggaaagtttatgttgatttcgttcggtatttaaggcgtgggtagcggtttaacgtttgttgcgggaatatagtcgcgttgaatgttatttttaagatagataaaatagtg

SEQ ID NO: 152 - DNA, 2413 bp, Artificial Sequence
  chemically treated genomic DNA (Homo sapiens)
ttgttcgttttatttagggatagatttgtagggtagggatttttttgtttatagaggtatacgtggtttcggcgtgttttaaaatttagttttttatggtcgttttaatttgagttttgtttttaaggttttaaagttagtttgtttttttagaggtggggggaagtagttgtgttttttattttaggatatatacgtatttattttttataatatataggtagatatatatttagtttttataaaattatgggtagatatatgtttagtttttatagtgtaacggttttaaacgtattcgattttaacgttatatatatatatttggtttttataatattagggttatatatatttttcgtttttatgatgttatagtttcgggcgtttttttattttggttattgtttttggtgtggtgtttttattggtgagataggatgttggttttagagtttatcggttttcgtttatattgtgtgggtattaatgttgttaggtatagttggtggtgagttttgggcgttttttaggtaggttgtgtcgattttcgttttatttgtattgaattgtttttgaggtttatttattgttgattttacgtagggttatatttggtttattggttagtgttaaagtttatttggtttattgggtttggttttattttgtttaatttatttttggtcggatttttttgttacgttttttagtatcgtattatttttagtttgtttagtttttatttttgtcggtagtataagcgttgtttagaagagttgggggtgtttgcggatttttttgttggttttcgtgatgtcgttttaatttatattttttttttcggtaagggaaagagaagagaataaagtgtagtaggtttagatttagaagtttaggtttatgagttaatagaagatgttaagatgttgatgtagtacgatttaggagatagtagggaatatagttttagcggaacgagattaggttttgttttttatttcgggttcgtcgaggggacgtgcgtatttatttggttattattatttttatgagtatttttagggtcgggtattttttttacgtagttaggtttagggaatcggagggtgtggggttggttaggtttttttgggtattaggcgtgtgattttcgttttttttagtttttttttttatttttagttgggtttattttaagttttaatagataaattgttttaaaggaataaggattagtagggttacgtgtgcgtatggggcggttagtagaggtttatcgatgttttttgggttgaatgcggcgacgattagtaggaggggttaggttttttagtagagggtagagatggcgaggttcggaggttggtatttggaaggtaggggcgtttcgatttaggtttagcgtattaagtttagcgttaaggatcggtcgggttaggtggtaaagttggggtagggacggtgttggtttttagtttttttcgggattgttttttagtgatatttgtttaagtatgtgtattagtttggttttgggttttttgtttaggttcgatttcggttttgtttttatttttttaagtttttgttttttatttataaaacgggagcggtggtggatatataataaacgtttattaagtgataatgatttttgtattttatatgatataatagatattattttaggagttatcgagatggaattattgtaacgatataattaaattaaagtacgggtttttcgggtgaggaaacggattttggttatgagatagatgtgaatcgaggtattgtttggagttatatgtagaggttgttgagtgggaaagattatattagaaagtagagcgggtagtatttgtcgaaggagagaggtaggagaattttaattatagtattagagagtacgcgaggtttaagtgtagtgcgggatttcgaagtgcgttcgattaaaattttaaacgttattgaaagggtgttagttttgtataaagggacgtttttgaaagggtgttagttttgtataaagggacgtttttgaaagggtgttatttttgtataaagggatatttttgaaagggtgtcggtttcggataaacgggaatttttgaaagggtgttggtttcggataaacggatattattgaaagggtgttagtttcggataaacgggaatttttgaaagggtgtcgtttttggataaacgggaatttttgaaagggtgtcggttttggataaagggaaatttttgaaagggtgttagttttggataaagggaaatttttttacgtgtacggatcgtagggcgtggttttattgatatggtggtattttttagattgatttatggattttatattgtttttttcgaaattttagttatttgttttgtagaaattgataagttt

SEQ ID NO: 153 - DNA, 2413 bp, Artificial Sequence
  chemically treated genomic DNA (Homo sapiens)
gagtttgttagtttttgtaaaatagatgattgggatttcgagggagatagtgtggaatttatgggttagtttggggagtgttattatgttagtgaggttacgttttgcgattcgtgtacgtgggaggatttttttttatttagagttgatatttttttaggggtttttttttatttagagtcgatatttttttaagggttttcgtttatttagaggcgatatttttttaggggttttcgtttattcggagttgatatttttttagtggtgttcgtttattcggagttaatatttttttaggggttttcgtttattcggagtcgatatttttttaggggtgtttttttatgtagaggtgatatttttttaggggcgtttttttatgtagagttgatatttttttaggggcgtttttttatgtagagttgatatttttttagtagcgtttggagttttggtcggacgtatttcggaatttcgtattgtatttgagtttcgcgtgttttttgatgttgtggttgaggtttttttgtttttttttttcggtaggtgttgttcgttttgttttttggtgtggttttttttatttagtagtttttgtatgtggttttaggtagtgtttcgatttatatttgttttatagttaggattcgtttttttattcgaggggttcgtgttttgatttaattgtatcgttataataattttatttcggtggtttttggggtggtgtttgttatgttatgtagagtataaaaattattgttatttaatgaacgtttattatgtatttattatcgttttcgttttgtagatgggaaatagagatttagaaaggtaaggatagagtcggagtcgggtttggatagggagtttagagttaggttgatgtatatgtttggataggtgttattggagggtagtttcgggaggagttgggagttagtatcgtttttgttttagttttgttatttggttcggtcgatttttggcgttgagtttggtgcgttgggtttgagtcggggcgtttttgttttttaggtattagttttcgaatttcgttatttttattttttattggaaggtttggttttttttgttggtcgtcgtcgtatttaatttagagaatatcggtgagtttttgttggtcgttttatgcgtatacgtggttttgttggtttttatttttttggggtagtttgtttgttgggatttgggatgagtttagttggggatgagaggaggagttgggagaagcgggggttatacgtttggtgtttaggggagtttggttagttttatatttttcggttttttaggtttggttgcgtgggaggagtattcgattttgaagatgtttatggagatggtgatgattaagtgagtgcgtacgttttttcggcgggttcgggatggggagtagggtttggtttcgtttcgttggggttgtgttttttgttgttttttgggtcgtgttgtattagtattttagtattttttgttgatttatggatttgagtttttggatttaagtttgttgtattttgttttttttttttttttttgtcgggagagggggtgtggattgaggcggtattacggaggttagtagggaggttcgtaggtatttttagtttttttgggtagcgtttatgttgtcgataggagtggggattgggtaggttgggggtggtgcgatgttggaggacgtggtaagagaattcggttagagatgggttagataggatggagttaggtttagtgggttaggtgggttttaatattggttagtgggttaggtgtgattttgcgtgggattagtagtgggtgagttttaaggatagtttagtgtaggtgggacgagagtcggtatagtttgtttaggagacgtttagggtttattattagttgtgtttggtagtattggtgtttatatagtgtgggcgagggtcgatgagttttggggttagtattttattttattagtgagggtattatattaagggtagtggttaaggtgaaggggcgttcgaggttgtggtattatagggacggggagtgtgtgtggttttggtattgtggggattaggtgtgtgtgtgtggcgttgggatcgggtacgtttggggtcgttgtattgtgaggattgggtatgtgtttgtttatggttttgtggggattgggtgtgtgtttgtttgtgtgttgtggggagtgggtgcgtgtgtgttttgaggtgggaggtatagttgtttttttttatttttgaaggagtagattgattttggggttttggggatagagtttagattagagcggttatggggagttgggttttggaatacgtcgaagttacgtgtgtttttgtaggtaagagagtttttgttttgtaggtttgtttttggatggggcgggtag

SEQ ID NO: 154 - DNA, 2171 bp, Artificial Sequence
  chemically treated genomic DNA (Homo sapiens)
taagagaaaaataaaaaattttattaaacgttacggataaggttagagtttgaatatattgtggttatttttgttttagtgtaaattgtttttagaaagtttatttttattttttttgttgtaatagaggaatattttttgttttatgtttattttattttgtaattttttaaggtttttttttttttttttagaattttaaagtgtattcgaatttataggtaaaatttttttagaattttgtgagaatataaatgatttgattagtttggtattgtttttggggatttgggaaaatttgtgtatatttttggagatttttgttatgttattatttataaatttattgtgttttaagttagaagtgtgtgaggggagatggggagatattgggatgcgcgcgtttggggtttttttatagggggttttcgtgagttaggtagcgagggtcgttttcgcgttgtagtttagttaggtcgcgtcggtagaggggattttttaatttgtttcggcgcgcggggatttcgtttacgtcgtttcggttttttcggagtcggggcgtttttttatttttaggtttttcggtggttttcgtattcgggtaaaagtcgggaggatcgggattcgtagcgcgacggtttgtcgggtttttgcgcggtggtatagtttgggttcgtttaagcggggtcgtagggttaaggggtgtttgcgttatttacgttttaggggagttcgtggtggggttggggtcggggtttttaggtcgtcggggcggcgtgggaattttaagtcggggtagttttatttttttagttcgcgtttttcggacgttttcgttttcgcgcggtaggggtagatgtaaggtatttcggcgtttttttaggcgttttaggagtcggcgttttggtttgtatttttttgcggtttgttgttggatgagtttttggcgagttcggagtttttgtagtaggcgtaattttttttagaaacggaggtttcgggggagttggaggtttcggaagaggcgtttcgttggaagtattttttagcgaggaagaatatcgggttttgttggaggagttttaggacgcggggttgggacggggtcgggtggttcggggtagggcggtggtttttttttcgcggggaatatttggttggttacggaggggcgtgttttcgtttcgttttttttatcgggttgatcggtttgggatttttgttttttaggtttaggtcggtgagagattttatatcgcggagaattgttatttttttttgggtatttcggggattttagagtcggtttaggtattagtaggtgggtcgtttattgcgtacgcgcgggtttgcgggtagtcgtttgggttgtgggagtagttcgggtagagtttttttgtttttttattagtttatttcgtcgtttgatcgttttatttttattttttattttttattttcggaaaacgcgtcgttttttgggttgggtggagattttcgtttcgcgaaatatcgggtttcgcgtagcgttcgggtttgatatcgtttcggcggttcgttttttttttgtcgttttcgggttatcgtcgttcgtcgttcgggtttttgtagtcgtttagttgttagtacggagcgtttggcggcggaacgtagattttaggttcggcgtatatcgggacgttgagcgttttaggcgggagggaaggcgggtagagatggagagaggaacgggagatttagaggggcggaaggatgggcggagggacgttaggagggaggtagggaggtagggaggtagggaggaacggagggagagatagagcgacgtagggattgggggcgggcgggagggagtcggggacggacggggggaggaaggtagggaggaaaagcggttttcggttttcgggagtagcgggattttcgtttttcgggaaaacggttagcgttcggcgcgggttgagggttgggtttatagtcgtcgcgtcggtcggcggggtattatttattcgtttcggtttcggggtttagggagtgggcggtttttttcgggataaaagatcgggattcgggttgtcgtcgggtttttattcgcgcggtttatagatcgtatatttttaggttgagttttgtaacgcggcgcgaggtcgatagattcggttacggaggag

SEQ ID NO: 155 - DNA, 2171 bp, Artificial Sequence
  chemically treated genomic DNA (Homo sapiens)
ttttttcgtggtcgggtttgtcggtttcgcgtcgcgttgtagggtttagtttggggatgtgcggtttgtgaatcgcgcgggtgaaaattcgacggtaattcgagtttcggttttttgtttcggaggaaatcgtttattttttgggtttcggaatcggggcgaatgggtggtgtttcgtcggtcggcgcggcggttgtgggtttagtttttagttcgcgtcggacgttgatcgttttttcggagggcgggggtttcgttattttcggaggtcgaggatcgttttttttttttgttttttttttttcgttcgttttcggttttttttcgttcgtttttagtttttgcgtcgttttgttttttttttcgtttttttttgtttttttgtttttttgttttttttttaacgttttttcgtttattttttcgtttttttaggtttttcgtttttttttttatttttgttcgttttttttttcgtttggaacgtttagcgtttcggtgtgcgtcgggtttggggtttgcgtttcgtcgttaggcgtttcgtgttggtagttgggcggttgtaggggttcgggcggcgggcgacggtggttcgggggcgatagggaggaggcgagtcgtcggagcggtgttaggttcggacgttgcgcggggttcggtgtttcgcgggacgggggtttttatttagtttaggggacgacgcgtttttcgggggtggggggtggggggtggggatggggcggttaggcggcggggtgggttggtggagaggtaggagagttttgttcgggttgtttttatagtttaggcggttgttcgtaaattcgcgcgtgcgtagtaggcggtttatttgttggtatttgggtcggttttgggattttcgggatgtttaggaaagaatggtagtttttcgcggtgtggagttttttatcggtttggatttagaaggtaggaattttaggtcggttagttcggtggagggggcggggcggagatacgttttttcgtagttagttaggtgtttttcgcgaaagagaggttatcgttttgtttcgaattattcgatttcgttttaatttcgcgttttaaagtttttttagtagagttcggtattttttttcgttgaggggtgtttttagcgaggcgtttttttcgaggtttttagttttttcggggttttcgtttttaggagaggttgcgtttgttgtagaaatttcgggttcgttaggagtttatttagtagtaggtcgtaggggagtgtagattagggcgtcggtttttggagcgtttgggagggcgtcgggatgttttgtatttgtttttgtcgcgcggaggcggaggcgttcggggggcgcgggttggggaggtggagttgtttcggtttggggtttttacgtcgtttcggcgatttggggatttcggttttagttttattacggatttttttgggacgtgggtggcgtaagtattttttggttttgcggtttcgtttgagcgggtttaggttgtgttatcgcgtaggggttcggtaggtcgtcgcgttgcgggtttcggttttttcggtttttgttcgggtgcggaggttatcgaggagtttgagggtgggagagcgtttcggtttcggaggagtcggggcggcgtaggcgaaattttcgcgcgtcggggtaggttgggagattttttttgtcggcgcggtttggttgggttgtagcgcgggggcggttttcgttgtttggtttacgaaagttttttgtgggagagttttaggcgcgcgtattttaatgtttttttatttttttttatatatttttgatttgaggtataatagatttataaataatggtatgataagggtttttagaagtgtgtatagatttttttagatttttaaaagtaatgttaaattagttagattatttatgtttttataagattttgggaggattttgtttgtgagttcgaatgtattttaagattttgggagggagagaaaaagttttaggggattgtagagtagaataagtataagataggaaatgtttttttgttatagtaaggaaaatagaagtaggttttttgaaaatagtttgtattggagtagagatgattatagtatatttaaattttggttttgttcgtgacgtttaatagggttttttgttttttttttg

SEQ ID NO: 156 - DNA, 2490 bp, Artificial Sequence
  chemically treated genomic DNA (Homo sapiens)
gattagtacggttattatatttatagttattagttttagagttatttttttttttagtttagggattgtaatcgtttttttagtattgagaagtatagttattatatttatagttattagcgttatagttattttttttttttttttgggtatcgtttggattcgtttattatagattattatatttacggttattatgtttatagttatatttttttttattttagagattgtttatatttttatagtgtttattattacgattattataattagggttatcggttttgtggttatttttttttttattttaggaatagtttatattattaaagtgtcgattattataattacgggttttatagttatttttttttttagtttagggacggtatttacgtttttagtgtggattagtataattattatatttataattagaggttttacggtgatttttttttttatttcggggattatttatatcgttatagtgttgattattattattataattgtggttattggttttatggtaatatttttttttagtatatagattagtggtatttttttattattgattattacggttattacgattatagttatcggttttattattaatttttttttaattttagggataatttttatttttttagtgttgattattatcgttattatatttgtagttattagtagtatagtgatttttttttttgttttagggattatttatatatttttagtgtcgaatattacggttattatatacgggcggtttttgttttttagtagtttttatacggtgcgtatagtttggatttcggttatttcgggtattttgggtattatttatattatagagttttttacggtgattttttatattttagtagtaattattagtattatttagtattcgattttagttttgtttagtttttattttagtagtaggattatcgagttatttttttttttagggacgattatttcgggttatattaggggtatttttaggattatagttatagttatatttagtaagattcgtatttcgattttgttgtttagtagttttatatcggtttttataattacggtggtgattacgggttgtgagttttagtgtgtttggttagagtggttggattatagttattttatgtcggggttttttggcggggattttgatatttattttaatattcgtgcggtcggaggggtagtttgtgagtagtttttgggtttcgagtgtcgtgtttaggtttagtttggtgtttttttgcgggagttgggttaggtcgtggaatgtagtttggattttggtttggtttgtaggaatcgtgagtaggtggggaagtttaagatgtgttttaattatgaaattcgtgtgttttgttgtaattacggttattgttttagtatttcggttattagttttacggttacgttttttttaatttcggggacgatttggatttttataaagttgattataatagttattacgattgagtttattggatttacggttatttcgttttttattttagggattatttggatttttatagagtcgagtattatagttatcgtgacggtgtttatcggatttacggttatcgttttttttatttaggtaattgttggtattttatatgtgagtattacggttacgatatttatagttattagttttaaagttatttttttttttagtttagggattgtaatcgtttttttagtattgagaagtatagttattatatttatagttattagttttatagttattttttttttttttttgggtattatttggattcgtttattatagattattatatttacggttattatgtttatagttatatttttttttattttagagattgtttatatttttatagtgtttattattacggttattataattagggttatcggttttgtggttatttttttttttattttaggaatagtttatattattaaagtgtcgattattataattacgggttttatagttatttttttttttagtttagggacggtacgtacgtttttagtgtggattagtataattattatatttataattagtggttttacggtgattttttttttcgtttcggggattatttatatttttatagtgttgattattattattataattgtggttattggttttatggtaatatttttttttagtatatagattagtggtatttttttattattgattattacggttattacgattacggttatcggttttattattaatttttttttaattttagggataatatttatttttttagtgttgattattatcgttattatatttgtagttattagtagtatagtgatttttttttttgttttagggattatttatatatttttagtgtcgaatattacggttattatatacgggcgatttttgttttttagtagtttttatacggtgcgtat

SEQ ID NO: 157 - DNA, 2490 bp, Artificial Sequence
  chemically treated genomic DNA (Homo sapiens)
gtgcgtatcgtgtggggattgttgggggatagggatcgttcgtgtgtggtggtcgtggtgttcggtattgggggtgtgtgggtggtttttagggtagaggagggagttattgtgttgttggtggttgtaggtgtggtggcggtggtggttagtattggggggataggtgttgtttttggagttgaggaggggttggtggtggagtcggtggtcgtgatcgtagtggtcgtggtgattagtgatgggggagtattattggtttgtgtgttagaggagggtgttgttatagaattagtggttatagttgtggtggtggtggttagtattgtgggggtgtgggtggttttcgggacggaggagggggttatcgtggagttattggttgtgggtgtggtggttgtgttgatttatattggaggcgtgcgtgtcgtttttgggttggaggagggggtgattgtgaagttcgtggttgtggtagtcggtattttggtagtgtgagttgtttttggggtggaagagggggtggttatagagtcggtggttttggttgtggtggtcgtggtggtaagtattgtggaggtgtgggtagtttttggagtggaggagggtgtggttgtggatatggtggtcgtgggtgtggtggtttgtgataggcgggtttaggtggtgtttagggaggaggaggggatggttgtaaagttggtagttgtgggtgtggtggttgtgttttttagtgttggaagggcggttgtagtttttggattggagaagggagtggttttggagttggtgattgtgggtgtcgtggtcgtggtgtttatatgtggggtgttagtagttgtttgggtggaggaggcggtggtcgtggattcggtgggtatcgttacggtggttgtagtgttcggttttgtgaggatttaggtggtttttggggtggaggacggggtggtcgtggatttagtggatttagtcgtagtggttgttgtggttagttttgtgaggatttaggtcgttttcggagttgaggagggcgtggtcgtagagttggtggtcggggtgttggggtagtggtcgtagttgtagtagaatatacggattttatagttgaagtatattttgaatttttttatttgtttacggtttttgtagattaggttaaagtttaggttgtattttacgatttggtttaattttcgtagggggatattaggttgggtttgggtacggtattcgaggtttaggggttgtttatagattgttttttcggtcgtacggatgttggagtaggtgttaaagttttcgttagagggtttcggtatggggtagttgtagtttagttattttgattaggtatattggggtttatagttcgtggttattatcgtggttatgggggtcgatgtggggttgttgggtagtagggtcgaggtgcgggttttgttgggtgtggttgtggttgtggttttggaggtgtttttggtgtggttcggggtggtcgtttttggagaagggggtgattcggtggttttgttgttagggtgagggttggatagggttggagtcgagtgttgggtggtattggtggttgttgttggggtgtgggaagttatcgtggaaggttttgtgatgtgggtggtgtttaagatgttcgaggtggtcgaagtttaggttgtgcgtatcgtgtggggattgttggggggtagggatcgttcgtgtgtggtggtcgtggtgttcggtattgggggtgtgtgggtggtttttagggtagaggagggagttattgtgttgttggtggttgtaggtgtggtggcggtggtggttagtattggggggatgggagttgtttttggagttgaggaggggttggtggtggagtcggtggttgtgatcgtagtggtcgtggtggttagtgatgggggagtattattggtttgtgtgttagaggagggtgttgttatagaattagtggttatagttgtggtggtggtggttagtattgtggcggtgtgggtggttttcgggatggaggagggggttatcgtggagtttttggttgtgggtgtggtggttgtgttgatttatattggaggcgtgagtgtcgtttttgggttggaggagggggtggttgtgaagttcgtggttgtggtagtcggtattttggtagtgtgagttgtttttggggtggaggagggggtggttatagagtcggtggttttggttgtggtggtcgtggtggtaagtattgtggaggtgtggatagtttttggagtagaggagggtgtggttgtggatatggtggtcgtgggtgtggtggtttgtgataggcgggtttaggcggtgtttagggaggaagaggggatggttgtaacgttggtagttgtgggtgtggtggttgtgttttttagtgttggaagggcggttgtagtttttggattggaggagggagtggttttggagttgatgattgtgggtgtggtggtcgtgttggtt

SEQ ID NO: 158 - DNA, 2418 bp, Artificial Sequence
  chemically treated genomic DNA (Homo sapiens)
agtagagttggggtgtggagtcgggttttttcgttattattgttatttttaacggtgttagtgttggtgggtgtgtaagggtcgcgaaagttatcgtgtgtggtatggtaggttttatcggagggtttttttggtcgaggggtttgttgtggcgttggaggggtaggggtttattgttttttatgaggtttttttttttttgatagtggcgagaaggcgttcgtttattagcgtttttatgttttggtttagttcggtttgtcgggattcgtgttgttttataagtattaggtgttggcggagatgtttcgtagtatggatattatcgtgggtatgttttataatcgtttcgagacgtttatttttgttaaggtttagcggggcgtttaggatatgatgcgtaggtgagtggtcgggggtgggttgtggttgttttggagttgggggtgggttcgggtttgttttttgagtcgtttttatttttttataggcgttttgaggagtgtaatgttggttagattaaaatcgtgtattcggttttttatcgttttcgttaggagcgtagtgtttttatttttaaggatggtattaggaggttagattattagtttattatcgagttattgttggagtagggtgagtgttgggtgcgggatttcggtttttttatttgtgagtcgtatagtttttagggtgggtgtgaggtgttgggtatttggtttaggattggttacgggtgggtggttgggtggtttggtggggatttaggtttggattcgttttatagaggttgacggagtagttttttagtttacggtttcgcgttttttgtagcgacggtagatttttagttagaagttggtggagtatgttaaggagtattataaggtgagcggttttcggtttcgttgtgtgaagatggtggtattagtattgttttagtatttaattttgtgtttggagtatttttgttatttatagtttttttcgggatggaattgggttgggtttattttgagttgagggttggtgtgtttagggtgtagtcgtaggtattgaggaggtttttaaggcgtttagcgagcgcggattatgggaggttttgtgttttttttttaagttgagtattgggtagaggttgagtgatttgttcgaggcggttcggttgggacgtaagtataggtttattttatatgtagtttgtttttgttttagatgtgtttagggttatttatttattttttttttttaggtttttttggtttttttgagtttcgttatggtggtgtcggaggattagttgattcgttggtattcgcgttttaacgtggatgaagtattcgatatcgagtcggtcgcgttgttttagttattcgttacggagaagtttattattgtttaggaggtgttggttcgggttcgtaatttgattttatttagggtgagattgcgaggtttgggtagtttatttttttcgggtgggtgggttagtttgattttaggtttaagaggtggaagttttggtgatgagtttgacgttttatttggttttttttttggttggcggatttagagagttggtggtatttgttttttgtttttagttgtagtttttaagtttggttttgttattagttttatgtggggagttggtttgggtaggcgatgttgtatattgggatattgtattgatcggtatagattatttagtgtgttgggtgaatttgtgttttgagagatatcggggatttttgggtagatagttaggggtacgttgtattttgtgatttttttagtttaatttgtttttttcgtagatggagaaggttttgagttaattggttttgcgttttgttgcgtttagtagtttcgggttttttaggttagtattgtcggttattttattagttatttcgtttgtagttttttttagtgttttgaagggggtgttttaggatttgttggagcgggtgagtcgtttttagtgatggcgggtgggcgtttggtgatttgttgtttattaattaggtttcggtatttgttgtagattcgagttaaggaggtatagaagtagttggtatagatgacgcggtgttcggagtaggagtagcggttgtagcgtttagaacggttgtttgagttggttcgcgtgttgcggagcgtttttgtgttcgaacgtaagtttgcgtttagtatggaggtggtttgtgttaggatggtgggtagttgttgtattattatgagttttggtacgtgtagggcggggtgaaggggcgtgtagggtggaattgtttggtgttgtagttgtttttttagttttttgagtagaggtgtttgttattgatttgttttgtttagatgtgtagtgggcgttggttttttgtattggtgtgttttgggcgttttgttttttttgga

SEQ ID NO: 159 - DNA, 2418 bp, Artificial Sequence
  chemically treated genomic DNA (Homo sapiens)
tttaaggagggtagagcgtttaggatatattagtgtaagaggttagcgtttattgtatatttgaatagaatagattagtgatagatatttttgtttagaaagttggggaggtagttgtagtattaggtaattttattttgtacgtttttttatttcgttttgtacgtattagggtttatgatagtataatagttgtttattattttggtataggttatttttatgttgagcgtaggtttgcgttcggatataaagacgtttcgtagtacgcgggttagtttaggtagtcgttttaagcgttgtagtcgttgtttttgtttcgggtatcgcgttatttgtgttagttgtttttgtgtttttttggttcggatttgtagtaggtatcgggatttggttagtgggtagtaggttattaggcgtttattcgttattattggggacgatttattcgttttagtagattttgggatattttttttagagtattgggagaggttgtaggcggggtggttggtggggtagtcggtagtgttggtttgggagattcggggttgttgggcgtagtagagcgtagggttaattgatttaaggttttttttatttgcgggagggataggttggattggagaggttataagatgtaacgtgtttttggttgtttgtttaggagttttcggtattttttaaggtataagtttatttagtatattgggtggtttgtgtcggttaatgtagtgttttagtgtgtagtatcgtttgtttaggttaattttttatatggggttagtggtagagttaggtttagaggttgtagttggggatagagggtaaatgttattaattttttggattcgttagttaaggaggaagttagatgaggcgttaagtttattattaaggtttttattttttaagtttggggttaggttggtttatttattcgggagaaatgggttgtttaagtttcgtagttttattttgggtgaaattaggttgcgggttcgggttagtattttttgagtagtggtgagttttttcgtggcgggtggttggggtagcgcggtcggttcgatgtcgggtattttatttacgttgaagcgcgggtgttagcgggttagttggtttttcggtattattatggcggggtttagggaggttaggaaggtttggggagaaggagtagatgggtgattttgggtatatttgagataagggtagattgtatgtgaggtaggtttgtgtttacgttttagtcgggtcgtttcgggtaagttatttagtttttgtttagtgtttagtttggagggagagtataaggttttttatggttcgcgttcgttgaacgttttggggatttttttagtgtttgcggttgtattttgagtatattagtttttagtttagggtgaatttagtttagttttatttcgggagaagttgtgagtggtagggatgttttaagtatagggttaggtgttgaggtagtgttggtgttattatttttatatagcggggtcgggggtcgtttattttgtggtgttttttgatatgttttattagtttttggttgaagatttgtcgtcgttgtaggaggcgcgaggtcgtgagttggggggttgtttcgttagtttttgtgggacgagtttaggtttaagtttttattaggttatttagttatttattcgtgattagttttgggttagatgtttagtattttatatttattttggaaattgtgcggtttatagatggggaaatcgaggtttcgtatttagtatttattttgttttagtagtggttcgatggtgagttggtaatttgattttttggtgttatttttgaaggtggggatattgcgtttttggcggaagcggtaggaggtcgggtatacggttttgatttggttaatattgtattttttaaaacgtttatgggaggatgggggcggtttaggaggtaggttcgggtttatttttaattttaggatagttatagtttattttcggttatttatttacgtattatgttttggacgtttcgttggattttggtaaaggtgggcgtttcggagcggttgtggagtatgtttacgatggtgtttatgttgcggaatattttcgttagtatttggtatttgtagggtagtacgagtttcggtaggtcgggttgggttagggtatggaagcgttggtaggcgggcgttttttcgttattgttagggagggaggagttttatgagaagtagtaggtttttatttttttaacgttatagtaggtttttcggttagggagatttttcgatggggtttgttatgttatatacgatggttttcgcggtttttgtatatttattagtattggtatcgttaggggtagtagtggtgacgggaaagttcggttttatattttagttttgtt

SEQ ID NO: 160 - DNA, 2351 bp, Artificial Sequence
  chemically treated genomic DNA (Homo sapiens)
aggtcggtttcgtagttttcggggtcgagtttttaaacgtgagtcgggtgcgcgcgggattcgcggcggtttttcgaagtttcgttttttcggttcggggttcgttcggttcgttttaatagttgtttcgcggtcgtaggtttcgcgttttgtgtattagggaaaagtagttttcgagtttgtgtcggacgtttttgcgtttcgttatcggtcgttttcggtttttgggtgaggcgtttttttttcgtcgcgtttcgttgtcgggtgttttcggtttcggtttttcgtgatttttgattttttttggtgcgaataagatcgggcgtttcgtcgtcgacgcgaaggggttgtttgtgcgcggcgttgcgggtttttcgcgcgtggggtgtgcgtgtgcgtgttcgggttcggttttgtgtgtgtatcgcgggtttgtttagagtcgggattatcgggttgcgtgtgggtcgttaggttaggttttcgtttaggatgggttttaagttggaacgagaaaggggaaatcggtcgcgttgacgtcggggttttcgttgtaagcgagaggcggattcggcgtattcgcgcggttttggaaattttcgagaggttttagtttttcgtcggttttatttttgttaggtggggaaggtggttcgggatcgggttcgtttaggattagaagtggtgtttggtagttatttggttaggaggtcggagagtcgggtttagcgggagcgtcgagcgttggtttttttttttcgagagtttttagtgaggaaaaattttatgagaggtgattgttaggtttcggttttttgtttatatttggtcgagcgttgggaatttttttttttaggttttatagttgggatcgtttgttttaggttttttaaggtggttgaggtaggtttaggattatattgtttgttttgagtaagaaggtaggattcgttgaagaattttattttattaggcgatattttaagtagatgtgaattttttcggggattatagtttattattcgagttagaggcggtagggttagtattttagttagtaggtttttttttttttataatgttgattaggttaggggattgtggggttgggtaggggtaaggttatggttattaggttggtatttaggttgggtatagaatagtaattaggttagtggaggtgattttatgatttagtatttcgggggttatcgtcgagtgtgtatttggaggtgtaatttcgtttgtgtttttttggagattttattttaagttttagtttaggtgggttagttttttggattgggttttgtgaagggttaaatggtggcggtttcgggggtgattcgggtttttagttgagttttttaaggatagaggtggttattggggtatttaagtcggggttgtggtttagttgatgggaaatttatagttttttttatttgagtttgggggttaggaatagagtgaggatagtttagggatagggttttttttattgaagttagggcggtagggtcggtggggtaggggttgttgtagttttatatttataaatttaatgtttaataaaagtttattgtttttagggttgttgtgagttaggtgggtaggtggggggttagtattattaaggtgttttttggattattatcgtttttatagtatagttgggggtttttgtgtaggaggaggatgtgttagtcggtatttttattagagttgttttttgaggtttgatttttatttaggtggtagattttatgttttagatgttatatattttagggttgggggagtgttttttttataagttttatttagtttttggggtgggggagttgtagtttttattagatggggattgtgtgtgttttgttcgtgtttgagggtgatgcgtgtggaaggtgtgttggagatagggtagaggtaagcggggttggcggtttagtttatagttttttttttttttcgtagaaataggttaggttggttgggttttttttttttttattttttttggggtagttggtttcgtttattagttttttttttagagttaggacggtagttttttttttgaaggtcggttagggtagtagcgttaggacgttcggcgggaatttagcgttttgtttcgtttcggacgaaaatatagaggttgcggtggaggggtggagtgcggggttggtcgttagggtttggtgttttacggtagtggattgtgtgttatttataggtttttttttttagtttttggttgcgtaggtgtgttatggttcggaagttggtaggaggggtttgttaagttggtttgtggagtaattgttgggtgggttttttgggga

SEQ ID NO: 161 - DNA, 2351 bp, Artificial Sequence
  chemically treated genomic DNA (Homo sapiens)
tttttaaggagtttatttagtagttgttttataagttagtttggtaagttttttttgttagttttcgagttatggtatatttgcgtagttaggggttgagggagggggtttgtgggtgatatatagtttattgtcgtggggtattaagttttggcggttagtttcgtattttatttttttatcgtagtttttgtgttttcgttcgaagcggggtaagacgttggattttcgtcggacgttttggcgttgttgttttaatcggtttttagagggaaggttgtcgttttggttttggggaggggattggtggacggggttaattgttttagggagggtgggagaagggagggtttagttagtttggtttgtttttacgaagaaggaaggaggttgtgaattgggtcgttagtttcgtttatttttattttgtttttagtatattttttatacgtattatttttaaatacgagtaagatatatatagtttttatttagtgggggttgtagtttttttattttaggggttagatgggatttgtggagaggatatttttttagttttggggtatgtggtatttaggatatggggtttgttatttaggtggggattaggttttaaggagtagttttgatgggggtgtcgattggtatattttttttttgtatagaggtttttagttgtgttatgagggcgatggtgatttagagagtattttggtggtgttaattttttatttgtttatttggtttataatagttttggaaataataagtttttgttaagtattgagtttgtaaatgtggggttgtagtagtttttattttatcggttttatcgttttggttttagtaggggggattttgtttttgaattgtttttattttgtttttggtttttaggtttaggtggaggaggttgtaggttttttattagttgagttatagtttcggtttgggtgttttagtggttatttttgtttttggaaagtttagttggaagttcgggttattttcggagtcgttattatttggttttttataagatttaatttagaggattaatttatttgaattgaggtttggagtggggtttttagggaaatataaacgaaattatatttttagatgtatattcggcggtggttttcgaaatgttgggttatggggttatttttattggtttggttgttgttttgtgtttagtttgaatattaatttggtaattatgattttgtttttgtttaattttatagttttttgatttggttagtattgtggggaggggaggatttgttggttggagtgttggttttatcgtttttgattcgggtaatggattatggttttcggggaagtttatatttgtttaaaatatcgtttgatgaaatgaaattttttagcggattttgtttttttgtttagggtaggtagtgtgattttgaatttgttttagttattttggggggtttgggataagcggttttagttgtggagtttggaaggaggggtttttagcgttcggttaagtgtggatagagggtcgaggtttggtagttattttttatggggtttttttttattaaagattttcgggaaaaggaagttagcgttcggcgttttcgttgggttcggtttttcggttttttggttagatggttgttaggtattatttttggttttgagcggattcggtttcgggttattttttttatttggtagaggtggagtcggcggagagttggggtttttcggaagtttttagggtcgcgcgggtgcgtcgagttcgtttttcgtttgtagcgaaggtttcggcgttagcgcggtcggttttttttttttcgttttagtttagggtttattttgggcgagggtttgatttggcggtttatacgtagttcggtggtttcgattttgagtaggttcgcggtgtatatatagaatcgaattcgaatacgtatacgtatattttacgcgcggagggttcgtaacgtcgcgtatagatagttttttcgcgtcggcggcgaaacgttcggttttgttcgtattaagaggggttagaggttacgggaggtcgaggtcgagggtattcggtagcggagcgcggcgggaagggggcgttttatttaggggtcgggaacggtcgatggcggggcgtaggagcgttcggtataaattcgggagttgtttttttttggtgtatagagcgcggggtttacggtcgcggggtagttgttgggacgagtcgggcgggtttcgagtcgagggagcggagtttcggaaaatcgtcgcgagtttcgcgcgtattcggtttacgtttgggggttcggtttcgggagttgcgaggtcggttt

SEQ ID NO: 162 - DNA, 2427 bp, Artificial Sequence
  chemically treated genomic DNA (Homo sapiens)
ggtatttttggtatttttaagttatttgttttttagtttttgggtttaggattagattagtgttaaaatagttgtttttgggaggggttggatttttatcgtgggtagagagggtttttgttttttggggtaggaggggttattttggtagggtaaaaagagataaatagaaaaataatagtaataataatagtaataattcggggttgttgttatggggtttgttttgaataggttgcgtttagtttattgcgaggaaggacgtttagttaggttttggttgaagtttgtagttgggttggatatagtagttattggtttgtgttgtgggggatttgggtttgttatggttgtagtggggattttgtttgagatagatagagttggggtggtgattaatatcgtcggggtattttcgtaggaattgggtttggtgaattgtttagggacggggaaggagtagggtgaggtatggggatttcgatataggttgagtagcgggagaggaggttgaggaggggaaggagggggttcgtagagtagtttttagattttaagttcggttagggataagtttgttagttttaggtttatgttataatttgtagggtttttaagtttaagtttttttaaatttaatgggtaaattgagacgtaatataaataggtttttgattttggtgtttgagttttggatttgaagttttttacggtatttattgtgagttttttttagacgtattgtacgaagtgagtttgttagttttttttttaagaaacgtgttaggtcgggcgcggtggtttacgtttgtaattttagtattttgggagatcgaggcgggcggattttaaggttaggagattgagattattttggcgaatatggtgaaatttcgtttttattaaaaatataaaaaaaaaaaaaaaaattagtcgggtttggtggtaggtatttgtagttttagttattcgggaggttgacgtaggagaatggcgtgaattcgggaggcggagtttgtagtgagtcgagatcgcgttattgtagtttacgttgggcgatagagcgagacgttattttaaaaaaaaaaaaaaaaaaggtgttaaaattttaaaaaattttaagataaagtaagtgtgaaagtaagatttttaaattatttatggtttcggttggaagtagtttttgttttgtttggtaggaatttgggagggtgattggttttttgtagaggtgttgtaggttgggtttgttttgtgggtagatattgagtttaggggtttttttagtcggggttatttttgtatttttaggcgcgttggtttagtacgttttgtttagtggaggagttgagatgattagatagagagtttcgttttggtttgggagtagtttgcggttaagtttgttttatcgagtttattttcgggagtagtttgcggtcgagtttgttttatcgagtttattttcgggagtagtttgcggtcgagtttgttttatcgagtttattttcgggagtagtttgcggtcgagtttgttttatcgagtttattttcgggagtagtttgcggtcgagtttgttttatcgagtttattttcgggagtagtttgcggtcgagtttgttttatcgagtttattttcgggagtagtttgcggtcgagtttgttttatcgagtttattttcggtgtttttggtgtgggtttttttttttttttttgtggagaggagtttcgattttttagggattttagatttattttgacgtagttattgttggcggagtagggagagatttcggggtttgtagatgttgaggggttttttttgtagaggggttttggttattataggttagtttggaggtttttagttttgggggttggttatagtttagacgtttttttttcgttttttttatatttatttttattttttttgtttggttttaggtgatttagggtttggttatcgggtagttgagtagttatttttcggaggaggtgttgtttcgggttagcgtgttggtttttatcgtggtgggtttggttatggtgagggtttttcgttttgggtttatttatttgatttttttattgggtaaggttatttgggcggtattatttgtgtttaagtttttggggatttttttagttttttatatttattcggggttagttttttagtagggatagtagttagggtggggagggataggtaagattttagagaggagtttggtttcgtgaggtttttatttagttcggttttcgtttgtcgttttaggtttggatgtttagcgttttttatttttgttttttggtgttcggtttggtgtttagtttttgtatttttaacgtggttatcgatagtatgttgattaaggttgtttttatttcggatataggtgagtgtggttagcgagtggag

SEQ ID NO: 163 - DNA, 2427 bp, Artificial Sequence
  chemically treated genomic DNA (Homo sapiens)
ttttattcgttggttatatttatttgtgttcgaggtggagatagttttgattagtatgttgtcggtgattacgttgagggtgtagaggttgaatattaggtcgggtattaggaggtagaagtggaagacgttggatatttaggtttgggacggtaggcgggggtcgagttgagtgggggttttacgggattaggtttttttttggggttttatttgtttttttttattttgattgttgtttttgttgaagagttggtttcgggtgggtgtggggggttggaggagtttttaagggtttaagtatagatggtatcgtttaggtggttttgtttagtgagagggttaggtgagtgggtttaaagcggggagtttttattatggttaggtttattacgatgaagattagtacgttggttcggagtagtatttttttcgagaagtggttgtttagttgttcgatgattaggttttgggttatttagagttagatagagagggtagaagtgggtatgggggaggcgagggaggggcgtttggattgtggttagtttttaaagttggggatttttagattggtttgtggtggttagggtttttttgtagagaaggttttttagtatttgtaagtttcggggtttttttttatttcgttagtagtgattgcgttaggatgggtttgagatttttgaggagtcggggtttttttttataagggaggaaggaaaggtttatattagggatatcggggatgggttcggtgggataggttcggtcgtaggttgttttcggggatgggttcggtgggataggttcggtcgtaggttgttttcggggatgggttcggtgggataggttcggtcgtaggttgttttcggggatgggttcggtgggataggttcggtcgtaggttgttttcggggatgggttcggtgggataggttcggtcgtaggttgttttcggggatgggttcggtgggataggttcggtcgtaggttgttttcggggatgggttcggtgggataggtttggtcgtaggttgtttttaggttagggcgaggttttttatttggttattttagtttttttattaagtagggcgtgttgggttaacgcgtttgggagtgtaggggtggtttcggttggaggagtttttgggtttagtatttgtttatagggtaggtttagtttgtagtatttttgtaggggattagttatttttttaaatttttgttaggtagaatagaaattgtttttaatcggaattataaatggtttaaaaattttatttttatatttgttttattttagggttttttgggattttaatattttttttttttttttttttgagatggcgtttcgttttgtcgtttagcgtggattgtagtggcgcgatttcggtttattgtaagtttcgtttttcgggtttacgttatttttttgcgttagtttttcgagtagttgggattataggtgtttgttattaggttcggttaatttttttttttttttttgtatttttggtagagacggggttttattatgttcgttaggatggttttaattttttgattttgggattcgttcgtttcggttttttaaagtgttgggattataggcgtgagttatcgcgttcggtttaatacgttttttaaaggaagagttggtaagtttatttcgtgtagtgcgtttaagaggggtttatagtgagtgtcgtgaaggattttagatttaggatttagatattaaggttagaagtttatttgtgttgcgttttagtttgtttattaagtttaaaaaagtttgaatttaggagttttgtaggttgtgatatgaatttggagttaataagtttgtttttgatcggatttggggtttgggggttattttgcgggtttttttttttttttttttagttttttttttcgttgtttaatttgtgtcggggtttttatgttttattttgtttttttttcgtttttgggtagtttattaggtttagtttttgcgagggtgtttcgacggtgttggttattattttagttttgtttgttttaggtagggtttttattgtagttatggtaggtttaagttttttataatataggttaatgattgttgtgtttagtttagttgtaggttttagttagggtttggttaagcgttttttttcgtagtgagttgggcgtagtttgtttagaataggttttatggtaataatttcggattgttattattattgttgttgttgtttttttgtttatttttttttattttgttagggtggttttttttgttttaaaaagtagaggttttttttgtttacggtgggggtttagttttttttaggagtagttattttagtattagtttagttttgggtttagaggttgaagagtagatggtttggaggtgttaggaatgtt

SEQ ID NO: 164 - DNA, 2501 bp, Artificial Sequence
  chemically treated genomic DNA (Homo sapiens)
tttatatatattatgttttttaaatgatatattagttttttgagggtaatttatattggtaatagtttttagatgtggaaattgtgaagataatgttggtgatgtggaagtaatataaattttggagttttttagatttaggtttgaatgttagattgttttttatttagagtaattttagagtattattttttattttaatttttttttaggtttttttgtgtttatgtgttttttttatttttgtttattgtttatttagtgatttttgtatttttttttattgttagtgtgtagatatatagtttttttggttttgagatttatgttaattttattttattattttgttagtttatttaatttttattgagtaatgttagttgaaagttgtggtgggattaaatgttgtaatgagtatttaaatgaggttgaagtatttacgtattttatttatatatggtgaggtatatttaaggaaggttgtagttattaaaattttaggaaataattttttatttttttaggtgaaagggtttttaggtttttgtgttttggaaggtttatttatagttattttttaaatgataatgcgattgatgagtttagagtttagtttaaatagtaatggattggaagattagtttaggttttattaatgtggaatatagaataaattatgtttttgttttagtttgtttatttgtgaaatagagtttattatatttagttttttttgtttttaggtttgagttattttttttggttaaggtaagtaaatgtttatgatgtttggttgtgtataagataaagttataataaagttataatttattttttttttgtagaagattgtaaaaagtaaaagagatttaggtaaaaatttcggaatgatttttggaatagagagtttttttagaattagaagttaaaggaatttaaaatatagggaggtttagggtttttattgatataaaggaaagatgttttttttataggtttacgtttatattttttttttttttttatttttatttgtatttttatttttatatagggtttatgggattttttttataaaagagtagttgtagtaatttatattattttttacgtttggttgtttattaagaggcgaaaagtagttttatataggttttatttttggatagttttagttgtaaagtttaaaatatgcgaaggtaatttggaaaagtaagcggttgtatataaagtaaacgtttatagagttttggataaaattgagcgtttatgtgtatatggtaagtgtttttagtgtttgtgtgtttatttgtttgtttgggtgattttgtttttgagagtttggatgagaaatgtatggttaaaggtaattttagataggaagaaaggtagagaagagggtagaaatgatttttgatttttggggttgagggtttttagagtaaatggtataatgttacgaggttcgatttatttttatgacggaatttaaggttttagtaagtatttgttggtttggttatggtttgttttttagtttgtaggagatttttttatttttttatttgcgcgtttttattagttttgaaaagaatttttggtagttaggagtaggtatttttatcgttttttttttttttttttcgtttttattttgttggttttttagattgggttttggaattaaatttggtgagtgttggtttttaggaaatttggagttttggcgtttaaattttggtttaggaaagtaggagttatttaggaagtaggggttttttagggttagagttagttttttttgttttcgtttacgttgcgttagtatttgtttttttaaagttattaggtaggcgttagcgcgcggtgaggggaggggagaaaaggaaaggggaggggagggaaaaggaggtgggaaggtaaggaggtcggttcggtgggggcgggattcgattcgtaaattgttgtatttgttttttattttttagcgtttttttcgagatttcggggagttagtttgttgggagagcgggacggttcggagtaagtttagaggtagaggaggcgatagagggaaaaagggtcgagttagtcgttttagtgttgtataggagtcgaagggacgtattacgttagttttagttcggttttagcgatagttaacgttttttgtagcgcggcggtttcgaagtcgtcgttcggagttgttttttttttttcggtgaagtttttaaaagttgttaaagattcggaggaagtaaggaaagtgtttggtaggattgacggttgtttttgttttttttttttttatttcgtttttttttattttgttttttttttttttttcgttttttttttcgtagttgttttagtcggttatttttagttaattttttttattatttttttttttattcgttttttcgttttcgtcggtttagcgttgttagttcgagtttgtagagaggtaattttttttggttgcgagcgggcgagtt

SEQ ID NO: 165 - DNA, 2501 bp, Artificial Sequence
  chemically treated genomic DNA (Homo sapiens)
agttcgttcgttcgtagttaaagggagttatttttttgtaaattcgggttggtagcgttgggtcgacgggggcgggggggcgggtggggagaagggtggtgaggggggttggttgagagtagtcgattgaggtagttgcgggagagaagacgggggagggggggaaggtagggtggggggaggcggggtggagaggaggaggataaaggtagtcgttagttttattaggtattttttttgtttttttcgagtttttagtagtttttaaaaattttatcgaagaggaaagggtagtttcgggcggcggtttcgaagtcgtcgcgttgtaagaggcgttggttgtcgttggagtcgggttggggttggcgtggtgcgttttttcggtttttgtatagtattggagcggttagttcggttttttttttttttgtcgttttttttgtttttgggtttgtttcggatcgtttcgtttttttagtaagttggtttttcgggatttcggagggggcgttgggaggtggagagtaaatgtaatagtttgcgagtcgggtttcgtttttatcgggtcggtttttttgtttttttattttttttttttttttttttttttttttttttttttttttttttatcgcgcgttaacgtttgtttagtggttttggagaaataagtgttggcgtagcgtgggcgagggtaggagaggttagttttagttttggaggatttttgttttttgaatagtttttgtttttttaaattaaggtttaggcgttagggttttagattttttggaggttagtatttattaaatttggttttaaagtttaatttaaaaaattaatagggtggaggcgagggagggaggaaaaggacgataggaatatttgtttttggttgttaggggttttttttaggattgataagagcgcgtagatgggagagtgggagagttttttataaattgaggagtaagttatgattaagttagtagatatttgttgaaattttagatttcgttatagggatagatcgggtttcgtggtattgtgttatttgttttaggaatttttagttttaagaattagaggttatttttatttttttttttgtttttttttttgtttggaattgtttttaattatgtattttttatttagatttttaaaggtaaaattatttagataagtaggtaaatatataaatattaaaaatatttgttatgtatatataggcgtttaattttgtttagagttttgtaaacgtttgttttgtatgtagtcgtttgtttttttaagttgttttcgtatattttaaattttataattggaattatttaaggatagaatttatatagggttgtttttcgttttttgatggatagttaggcgtagaggatgatgtgggttattgtaattgtttttttgtggaggaggttttataagttttgtgtaaaggtggagatgtaagtgggaatggaaagagagagaaaatgtaaacgtaaatttataaggaaaatattttttttttatgttagtagagattttgggtttttttatgttttaaatttttttgatttttgattttggggaggttttttgttttaaaagttatttcgagatttttgtttgggttttttttgttttttgtagttttttatagagaaaagatgggttgtagttttgttgtagttttattttgtgtatagttaaatattataggtatttatttattttgattaaagaaggtaatttaaatttaaaggtaaggaagattggatatgataggttttattttatagatgaataggttgaaataaggatataatttgttttatgttttatattagtaaaatttaaattagttttttagtttattgttatttgagttagattttagatttattaatcgtattgttatttgggaaatggttataaatgaattttttagaatataaaggtttgaagatttttttatttgaggaggtgaaaaattattttttgagattttaatggttatagttttttttgaatatattttattatatgtaagtagaatgcgtagatattttaattttatttgaatatttattgtaatatttaattttattataatttttaattagtattgtttaataggaattgagtgggttggtaggatggtagaatggaattaatataggttttagagttaggagaattatgtgtttatatattaatagtgaaggaaggtgtaaaaattattgaatgaataatggataggagtgaagaggatatatagatataaagaggtttgaaaaaaaattaaggtgagaaataatgttttgaagttattttgaataaaaagtagtttgatatttaaatttgggtttgaaagattttaaagtttatgttgtttttatattattaatattgtttttatagtttttatatttgaaaattgttgttaatataagttatttttagaaggttagtgtgttatttaaaagatataatgtgtataga

SEQ ID NO: 166 - DNA, 3190 bp, Artificial Sequence
  chemically treated genomic DNA (Homo sapiens)
aggagtttaagattagtttggttaatatgatgaaattttgtttttattaaaaatataaaaattagttagtcgtggtggcgtatgtttgtaattttagttatttaggaggttgatagaggagaatcgtttgaatttaagaggcgaaggttgtagtgagttaagaatatattattgtattttagtttgggcgatagagtaggatttcgttttaaaaaaaaaagagttggttagtgttaaatgtttagtatagagattggtatagtaatttttaatgtttagtatttattgttattattttttttttttttttttttttgagatagagttttgttttgtcgtttaggttggagtatagtggcgcgatttcggtttattgtaagttttattttttaggtttatgttatttttttgttttagtttttcgagtagttgggattataggcgtttattattacgtttggttaattttttgtatttttagtagagacggggttttattgcgttagttaggatggttttaattttttgatttcgtgatttgttcgtttcggttttttaaagtgttgggattataggcgtgagttattatgtttggttttattgttattatttttattttttatttttgtatagagtatttatggtttaagaaatatttgttattttaattgtatgggagttttataatagtatagggagatatttttgattattatttttattaggagggtggagaaattgaggttttgggaggtggttttgatttagggaattaatttgttgatttattaatttatgaagttttatagttaaaaaagattagattaaaaaatgagaatttagtaaaggggttgaggtaggaggatcgtttgagtttagaaatttgagattagtttcggtaatatagtgagattttttttttagaaaaattttttaaaaaattaggtcgttcgaggtagagtgtagtggtttacgtttgtaatttaatattttaggaggttgaagagggtggattatttgaggttaggagttttagattagtttggttaatatggtgaaatttcgtttgtattaaaaatataaaattagtcggtgtggtggtatacgtttgtagttttagttatttaataggttgagataggagagttttttgaattcggtaggcggaggttgtagtgagtcgagatcgtgttattgtattttagtttgggtaagatagagcgagatttcgttttaaaaaatataaataaaataaataaataaaaaattaggttgttagtttagtggtttatggtttatatttgaaattttagtattttgggaggttaaggtaggaggatcgttttagtttaggagttcgagattaggttgggtaatatagggagatatagcgtttttattgtttttgttcgtttcgatttgtttttttataaaaaggtaaaagaaaaaaaaattagtttggcgtggtggtgtgtatttgtatttttagttattagagaggttggggttagaggatcgtttgagtttaggagttcgaggttgtagtgagttgtgatcgtattattgtattttagtttgggtgaaagagtgagattttatttttaaaacgaataaataaaaaattttaaaaaataaaagaatttagttaagtgtaaaagttttttttgattttaggttttagtgagttatcggcggggttgggattcgaatttagtggaattagaatcgtgtaggttttataatttatttagattttagtaattttaggttagagggttatcgcgtttatgcgaggtcgggtgggcgggtcgttagtttcgttttggggaggggttcgcgttgttgattggttgtggtcggtaggtgaatttttagttaattagcggtacggggggcggtgttttcggggtttatttggttgtagttacgtatttttttttagtggcgtcggaattgtaaagtatttgtgagtttgcggaagttagtttagattttagttcgttttagttcggttcgattcgatcgtattcggcgtttgttttcgttcggcgttttcggttagttatgggtttttggagtcgtagtttttcggcgttgttgttgttgttgtaggtatttcggattttttgatttgcgagggacgtattcgggtcgtaagtttcgcgttttagttttgcgtttttttttttttcgtcgttatcgtttttttttttttaagaaagttcgggttttgaggagcggagcggtttggaagtttcgcgcgtttcggattttttagtgatgggagtggggggtgggtggtgaggggcgagcgcggtttttttgttttttttagcgtagatcgaggcgggggcgtttggtcgcggagttcgcggggtgggttcgcgcgggcggtgggggcgtgaagcggggtgtagggggtggggtgtggagaaggggtgttttggtgtaagtcgagggggagttaggagtcgtggggacgattttcgagggaaggagaggggtattcgtagaaataaaggtatttgttatgttaagaaaggtcgtaaataggagtgagggtttcggggataagaaagtgaggtcggaggaggtgggagcgtttttcgttttgaggagtggtgtattttcggtttaaggaaagtggggtattggagaataaagatatttttaataaaatgagaaaggagattgaaagggaacggtgggttaggttttgagggggtgattcggcggttttttttcgggagtttttgggggttcggcggtcgtaggtttcggggtgggggagggtgacgtcgttgttcgttcgtttcggggttgcgggttggggtttttttttaatttcgacgtcgggagcgagggaggggcggcgttgttggtttcggtgagtaggagggaatttttcgagttattcggttttatttattttttttttattttaggtttttttttggttttgttaggagtcggagttttgttattttggttttgacgtcgagagttatacgtttacggtgtttcggcgttatttggagagaggtcgcgttttgggtagaggtgagggcgcgttgtcggtgtttttgggcggagtagggaggggttggaaaggggtcgagaaattgtatttttatatttttgggttgtaatgggtaagttttttttttggtttaaacgatattttttggaa

SEQ ID NO: 167 - DNA, 3190 bp, Artificial Sequence
  chemically treated genomic DNA (Homo sapiens)
ttttaaggggtgtcgtttgagttaaggagggagtttgtttattgtaatttaggggtgtgggagtgtaatttttcggtttttttttaatttttttttatttcgtttagggatatcggtagcgcgtttttatttttgtttaggacgcggtttttttttaggtggcgtcggggtatcgtgaacgtgtagttttcggcgttaaagttagggtggtagggtttcggtttttggtagagttaagaggagatttggggtgggggaaaggtagatggaatcgggtgattcggagggtttttttttgtttatcgaaattaatagcgtcgtttttttttcgttttcggcgtcgggattgggggaggattttagttcgtagtttcgggacgggcgggtagcgacgttatttttttttatttcgaaatttacggtcgtcgagtttttaggaattttcgggagggggtcgtcgagttatttttttaagatttagtttatcgtttttttttagtttttttttttattttattggagatgtttttattttttagtattttattttttttagatcgggaatgtattattttttagagcgaggggcgtttttatttttttcgattttatttttttattttcgggatttttatttttatttacgattttttttggtatggtaggtgtttttatttttacggatgtttttttttttttttcgaagatcgtttttacgatttttggttttttttcgatttgtattagggtattttttttttatattttattttttatatttcgttttacgtttttatcgttcgcgcgagtttatttcgcggatttcgcggttagacgttttcgtttcggtttgcgttggagggggtaggaaagtcgcgttcgttttttattatttattttttatttttattattggggggttcggagcgcgcgaggtttttaggtcgtttcgttttttaggattcgaatttttttggaagaagggaagcggtgacgacgggagaggaaggggcgtagggttggggcgcggagtttgcggttcgaatgcgtttttcgtaagttaggggattcggggtatttgtagtagtagtagtagcgtcgagaggttgcggttttaagggtttatggttggtcggggacgtcgagcgagggtaggcgtcgggtgcggtcgggtcgggtcgggttggagcgggttggagtttgaattgattttcgtaagtttataggtgttttgtagtttcgacgttattgagagggggtgcgtggttgtagttaggtgagtttcggaggtatcgtttttcgtatcgttgattggttgagggtttatttgtcggttatagttaattagtagcgcggatttttttttagggcggagttgacggttcgtttattcggtttcgtatagacgcggtgattttttagtttggagttgttagggtttaggtgggttatgggatttgtacggttttgattttattgggttcgaattttagtttcgtcggtggtttattaagatttgggattagaaagggtttttatatttggttgagtttttttgttttttgggattttttgtttgttcgttttggagatggggttttatttttttatttaagttggagtgtagtggtgcgattatagtttattgtagtttcgaatttttgggtttaagcggttttttggttttagtttttttagtagttgggagtataggtgtatattattacgttaggttaattttttttttttttgtttttttgtagagagataagtcggggcggataggggtagtgggggcgttgtgtttttttgtattgtttagtttggtttcgaatttttgggttgaagcgatttttttgttttggttttttaaagtgttaggattttaggtgtgagttatgagttattgagttagtagtttaattttttgtttgtttgttttgtttgtattttttgagacggagtttcgttttgttttgtttaggttggagtgtagtggtacgatttcggtttattgtaattttcgtttgtcgggtttaagagatttttttgttttagtttattgagtagttgggattataggcgtgtgttattatatcggttaattttgtatttttagtatagacggggttttattatgttggttaggttggtttggaatttttgattttaggtgatttattttttttagttttttgaagtgttggattataggcgtgagttattgtattttgtttcgagcggtttaattttttaaaaaatttttttagagaggggattttattatgttgtcgaggttgattttaaatttttgaatttaggcgatttttttgttttagtttttttattgagtttttattttttaatttagttttttttaattgtagagttttatgggttagtgagttagtaaattgattttttaggttaggattattttttaaagttttagtttttttatttttttaatgggaataatgattagaaatgtttttttatgttgttgtgggatttttatataattaaaatgataaatgttttttgagttataaatgttttgtatagaagtgaggggtaaaaatagtaataatagggttaggtatggtggtttacgtttgtaattttagtattttgggaggtcgaggcgggtagattacgaggttaggagattgagattattttggttaacgtagtgaaatttcgtttttattaaaaatataaaaaattagttaggcgtggtggtgggcgtttgtagttttagttattcgggaggttgaggtaggagaatggtatgaatttgggaggtggagtttgtagtgagtcgagatcgcgttattgtattttagtttgggcgatagagtaagattttgttttaaaaaaaaaaaaaaaaaaaaaatagtaataataggtgttggatattgaagattattgtgttagtttttgtgttaagtatttgatattgattagtttttttttttttgagacggagttttgttttgtcgtttaggttggagtgtaatggtgtgtttttggtttattgtaattttcgttttttgggtttaagcggtttttttttattagttttttgagtagttgggattataggtatgcgttattacgattggttaatttttgtatttttagtagagatagggttttattatgttggttaggttggttttgaattttt

SEQ ID NO: 168 - DNA, 2613 bp, Artificial Sequence
  chemically treated genomic DNA (Homo sapiens)
gaatggggaagtttttatcggcggttatttttttttttttttagtttgggttagagacgaattatttgtttacgaaattatattaaataaaataagtgtcgaatgcgtttcggatttttcgagggttttttttatttggttttttaggaagcggttgttgttttagacgttggttttttagtagtattagtacgagggttatagcggcgggcgtttttggcgttgtttattttttcgtgagtcgcgggatgtgaattacgaaaatttttattcgcggcgggtcgtacgcgcgtcgaattcggagggttattaagaatttgcgtattatgttttcgtcgtttttagggtcgagttcggtagtcgttgcgtcgttttttggtattagaggtgagtagcgttatttttgtttttttaattgtagattgggatttacgtatcgttttttgtttattttcgtttcgtaggcgcgtattcgttttttttgagcgcgttcgttttttatttttatttttatttttattttatttttatttttattcggatttttaagatttcggaacggttttgagttttgcgtacgcgggaagggttgtcggaggcgttcgtagggaggcgcgcgcgcgggcggtttagggttcgcgtttttttttttttcgtttatcgttattttttcgttttgtgtgcgtttttatttttattattatttttttatttttagcgcgggcgtttcgcggtgacggtttaggggtcggacgtttggaacgtaattttaggtagttcgttttttagttatattcgttatttgatacggttttattaggaatagtcgcgttttcgcggattttggtgttgttcgcgttttcgtttttttattttttttattttatttttggtttttttcgtcgaaagttttttattttttaaattagattatttaaaaatgaaaaaggaagaaaggaaagcgaggttattttattgttttattcgttaattaggaggttgaatgttagttttgaattaaaagtcgtttcgttttttttttagatttggaaaataagcgaaattaaattaaatcgttgtacgtttttgacgcgatatttggatacggcgcggcgttggcgttgtcggagttgtcgattcggtttggcgtcggattaggtaggtggagtcgtattcgggggttttagttgggttcgggcgtttattttttttttagttgttcgcgtcgtcgagggcgtttggttgggataagtatcgagttttttgtgtttagtttatttttattttcggttttaatttttacgatagtcgcggagtatttgagcgtttttttttttttttttttttttcgcgttttttttttttgttggtcgttttttttttgtcgtcgcgttttcgcgtagaatggttgttttggcgatcgttggtcgttgtcgtttttacgttttgtttcgcgtttagatatttcgattttttttgatttcgtcgtttgatttttcggcgtacgtttttttttcggtttttttttttatgttttttttttttttttttttttatattatcgattttttttggatttttttttttttttttttttagttgggagataggaaaagcggttttgtttgggaatagtaaaagtagggtaaggaaaggaaggagcggtagaaaggaggggtgagtcgaggatataggggtagtcggagaatgcggaggagtcgggttttgagcgcggtttaagcgaggttcggttttcgtttaggaattcggacgcgggttcgtcggtttttcgcgcgcgggaagtcgagtttaggacgtcgtttttaggtcggcgcgttgattcggtgtttcgattcggagtttgcggtttgtttggattcgttttaaatttcgcgggttggattcgcggtttgagtgggtgggtgtgtgttagaggattcgggattaggtttagtttcgggaatttggaaatgtggttcgttttttagtggttttttgtttatgcgtttgggtttagtggtttagttgaagaagtggaattatagcgtgagtcgatagggttttatagattagacgttaagttttttagattttataggggaggaaagtgaggtttgtattggtcgagttatttatttaaggcggtgcggtagtttagaggagcggtagatttttttttttttatttttcgttttattatttgacgttgttgtcggatttcggtataaatttaagataaaacggggttttttggaaaaagtgagatttagcgattatttttacgtagttattttaaatatttatttagatatttataaatgtattttttcggtaggtagattttatttagaatttatttaatatcgtgttttgtgttggggttatatgttatttttttgtttagtatggttgtttttttttttttttcgtaaatatagtttttttttttttaggttttttttgaagtaagtagtttttttttagaaatgtttttttttttaggtatttttatattatcgtgatttttttttttatagtatttaggacgaagagattattttatttatgtatttgtttatttgtttgttgtgtagaatgttagttttatgggaa

SEQ ID NO: 169 - DNA, 2613 bp, Artificial Sequence
  chemically treated genomic DNA (Homo sapiens)
tttttatagagttgatattttatataataaataagtaaataagtatataagtaaaataattttttcgttttaagtgttataaagaaaaaaattacggtggtatgagggtgtttgaaaagggaagtatttttgaggaagggttatttattttagaagagatttgaaggaaaaagagttatatttgcgaagagggagaaagagtagttatattagatagaaaggtggtatgtggttttagtataaagtacggtgttgggtaaattttgagtgaaatttatttatcggggaggtgtatttgtaaatatttagatagatatttagagtggttacgtaagagtgatcgttaaattttattttttttaaagggtttcgttttgttttgggtttgtatcgaggttcggtagtaacgttaagtgatggggcgggggatggggaaagagaagtttgtcgtttttttaggttatcgtatcgttttaagtgggtggttcggttagtgtaggttttattttttttttttgtaaggtttggggggtttgacgtttgatttgtaaggttttgtcggtttacgttgtggttttatttttttaattaggttattaggtttaagcgtatgaataggaagttattgagaagcgggttatatttttaggttttcggagttgggtttagtttcgaattttttggtatatatttatttatttaggtcgcgggtttagttcgcgaggtttaggacggatttaggtagatcgtaggtttcgggtcggggtatcgggttagcgcgtcggtttgaaggcggcgttttgggttcgatttttcgcgcgcggagagtcggcgagttcgcgttcgagtttttggacgagagtcgagtttcgtttagatcgcgtttaggattcggttttttcgtatttttcggttgtttttgtgttttcgatttattttttttttttgtcgtttttttttttttttgttttgtttttattgtttttaaataggatcgttttttttgttttttagttggaaaggaggaagggagagagtttagaaaggatcggtgatgtggaagaaaaggggaggaggggatatggagggggagatcggagagagaacgtacgtcgaggagttaggcggcgggattaaggggagtcggggtgtttgggcgcggggtagagcgtggaggcggtagcggttaacggtcgttaagataattattttacgcgaggacgcggcgataggaggggagcggttagtaggggaggggagcgcgggggaagaggaaagaggaagaagcgtttagatgtttcgcggttgtcgtgaaggttaaaatcgaaaataaaaatgggttagatataaaggattcggtgtttgttttagttaggcgttttcggcgacgcgggtagttgggaggggaatgggcgttcggatttagttgggattttcgggtgcgattttatttatttagttcggcgttaggtcgggtcgatagtttcggtagcgttagcgtcgcgtcgtgtttagatgtcgcgttagaggcgtgtagcggtttagtttaatttcgtttgttttttaaatttagaagaggagcggagcggtttttagtttaaaattgatatttagttttttgattggcggatagagtaatgagatgatttcgttttttttttttttttttttatttttaaataatttagtttgaagaatggaagattttcgacgaggggagttaggaataaaataaggggaataggggagcggggacgcgagtagtattagaattcgcgggagcgcggttgtttttggtagggtcgtgttaggtgacggatgtagttagggggcgagttgtttggagttgcgttttaggcgttcggtttttgggtcgttatcgcggggcgttcgcgttgagggtgggaagatggtggtgggggtgggggcgtatatagggcgggaaagtggcggtaggcgggagggagaggaacgcgggttttgagtcgttcgcgcgcgcgtttttttacgggcgttttcggtagtttttttcgcgtgcgtagggtttagagtcgtttcgagattttggaggttcgggtgggagtgggggtggggtgggggtgggggtgaaggtggggggcgggcgcgtttagggaaggcgggtgcgcgtttgcggggcggagatgggtagggggcggtgcgtgggttttagtttgtagttaagggggtaggagtggcgttgtttatttttggtgttaaagggcggcgtagcggttgtcgagttcggttttggaggcggcgagaatatggtgcgtaggtttttggtgatttttcggattcggcgcgcgtgcggttcgtcgcgagtgagggttttcgtggtttatatttcgcggtttacgggggagtgggtagcgttaggggcgttcgtcgttgtggttttcgtgttgatgttattgaggagttagcgtttagggtagtagtcgttttttagaagattaggtaggaaaggttttcgaaaagttcggggcgtattcggtatttgttttgtttggtgtgatttcgtaaatagataattcgtttttagtttaggttaggaggaggaggagataatcgtcggtggaggtttttttattt

SEQ ID NO: 170 - DNA, 2501 bp, Artificial Sequence
  chemically treated genomic DNA (Homo sapiens)
cgttattatattgtattgtttgtggatgatttatttgtttttgtagttttatttgaagaatttttttttttttttttttgaggtttgttttaaatattattttttttgtgaagattgtttggtgttttttaggagagagtgtgatttttttttttaggaatggtagtattttaaatatatatattttgtagtatattttattttgtatggtaatggtttgtttgtgagttttatttcgtattagagggtgagggttttgaagatagcgttaggttttatttatttcgatattttataatatttattatatgtttgatgaatgaatgtatagggggatggttgggtgtattttttttaattttttaattttttgaaataaataataaaattttatttttttttagaagttttggtatggttttttttattttgttatagttattgataattatttttattttttgtgtaatttattaggtaagaagtttatgtagatttatttttagtagtttatatgataaataaatattgcgtttgatttttaaatattaaattatagtatattatagatagatatagagttattatttaaagtatgatattttaattttaaaaggttttttttgaagaatattataaattttttttttttttaagatttgttgggtaggaaagatgggagaaaatgaattaatgtttatatagaaaggaggataatgggggtaaaaataatagatgaacgtatgggtggatgagagaatggataaaatgataggtggatatgttgattttggatagatgggaaatgagtggatatattaataaatagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggatttaagtggttagtggatggataggaggatggatggatgtgagagttttagaaggatataaggaaagatgggtggatagatggatgggcggatggaaggatatttaggaggatgaatgagtatgtgtgtggagagaggtgtttatttatattggtttgaatatatgggttagttgagttaaatgttagttttatgataggttattagtagttttttttgagttgttttgttaagaagttaaaatttatttaagttatgtggatttgttattgaggggaaaaagaatgagttttttttttttttatttggaagatttattaattttttattttttattttttattgtgggtacggaggtattgcgttatttagggtaagatttcgttttttttttagttttttttttaggatatttaatattttgtgaaatttagagattttgttttagtcggatttagagaaatttagcgggaaaggagaggttaaaggttgaatttaatggtgtaaggttttacggttcggttattttttgttttgacgtcgcggggttagcgggagaagaaagttagtgcgtttttgggcgtaggggttagtggggttcggaggtataggtatttcgcgatattttaggtttttcgatttacgtttttggtagtttcgattatttatagttttagtagagtacggggcgggggtagaggggttcgttcgggagggttgttattttttaaaatttttgcgggttgtttagttatagttttttttgtttgggtgtgtttttcgttcgtttttttttttcgttttaggttattgtttttaatttcgaataaaaattgtagttaattttcgaggtagttttattgtttagcggattttagtttttgttaggttcggttcgttattttcgtttcgtttttcgtcggtttttgtttcgcgtttagggattttttagtttttttcgttcgcgtttttcgttcgtttcggatattatggataagttttggtggtacgtagtttggggattttgtttcgtgtcgttgagtttggcgtagatcggtgagtgttcgtcgtagtttgggtagtaagatgggtgcggggtgtttagcgcggattcggcggtagttttttcggttgagtcggttttgggggattggagttaagtgagttgtttgcgaagtgtattgggtttcggaaagtagggttgggatttgcgttaaatcgttggagaatgtgtttgtggaagtattatttggttgaaagaaaaagagaaagagaagaaagtttgttgggtaggttgtcggcgcgtagttttgggcgaggtcgttagagttgtagtatatggtagaaagtaatcgttttttcggatgcgtatagtcgttgtttggattaataggtttttgtgtttaagggttcgttaagttttatcgggttgtgtttaggtagggtagagttgggcggggtagagattggggttggaatagggcgagtgg

SEQ ID NO: 171 - DNA, 2501 bp, Artificial Sequence
  chemically treated genomic DNA (Homo sapiens)
ttattcgttttgttttagttttagtttttgtttcgtttagttttgttttgtttagatatagttcggtggggtttggcgagtttttgggtataggagtttgttagtttagataacgattgtgcgtattcgggagaacggttattttttgttatgtgttgtagttttagcgatttcgtttaaaattgcgcgtcggtagtttgtttaataaattttttttttttttttttttttttttaattaaatggtgtttttatagatatattttttaacggtttagcgtaaattttagttttgtttttcggagtttaatgtatttcgtagatagtttatttgattttagttttttagggtcgatttagtcggaggggttgtcgtcgggttcgcgttgagtatttcgtatttattttgttgtttaggttgcggcgggtatttatcgatttgcgttaggtttagcggtacgaggtagagtttttaggttgcgtgttattaaaatttgtttatggtgttcggagcgaacggagggcgcgggcgaaaggagttggaggatttttgggcgcggggtaggggtcggcggaggacgggacgaggatggcggatcgaatttggtagaggttggggttcgttgggtaatgaggttgtttcggaagttggttgtagtttttattcgaggttgaaaatagtgatttaagacggagggagggagcgagcgaaggatatatttaagtaaggggggttgtgattaagtagttcgtagaggttttaagaagtagtagttttttcgggcgggtttttttgttttcgtttcgtgttttgttgaggttgtaaataatcggggttgttagggacgtgggtcggggaatttggagtgtcgcggggtgtttgtgttttcgagttttattggtttttgcgtttagagacgtattggtttttttttttcgttggtttcgcggcgttaggatagaggatgatcgaatcgtaaaattttgtattattgggtttagtttttggttttttttttttcgttaaatttttttgaattcggttggagtaagatttttgggttttataggatgttggatattttgggagaggagttggagagagggcgaggttttgttttgggtggcgtagtgttttcgtgtttatagtggggagtgaggggtggggagttggtgaattttttaagtggaaagagggagagtttattttttttttttttaataataagtttatatggtttgaatgaattttagttttttggtagaatagtttagggaaagttattgatggtttgttatagggttggtatttggtttagttaatttatgtgtttaagttagtgtgaatgggtatttttttttatatatatgtttatttatttttttaaatatttttttattcgtttatttatttatttatttatttttttttatgtttttttggggtttttatatttatttatttttttgtttatttattaattatttaggtttatttattattttatttatttatttatttaattatatattttttaatttatttaattatttatttttttatttatttttttatataattttttatttattattttatatttttttttttatatttttttataaaattataattatttattatttttttttttatttatttatttatatatttgtttattgatatatttatttattttttatttgtttaagattaatatatttatttattattttatttatttttttatttatttatacgtttatttattatttttgtttttattatttttttttttgtgtaaatattaatttatttttttttattttttttatttagtagattttaaagagaggaagagtttgtaatattttttaggggaagttttttgagattgaaatattatattttgaatgataattttatatttatttataatatattatggtttaatgtttggaaattaaacgtagtatttatttgttatgtgaattattaaaagtaaatttgtatggattttttgtttggtgagttatatagaaaatgaaagtgattattagtggttgtggtaagatgaaaggaattatgttaggatttttgagggaaggtaagattttgttatttattttaagaaattgaaaagttgagagaaatgtatttagttatttttttatgtatttatttattagatatgtaatgagtgttgtggggtatcgaggtaaataagatttggcgttatttttagagtttttattttttggtacggaataaaatttataagtaggttattattatgtaaggtgaaatatgttgtaaaatgtgtgtgtttggggtgttattatttttagagaagggagttatatttttttttggagaatattaggtagtttttataggggaagtgatatttgaggtaggttttaaaggaaaaggaggaggaattttttagatgaaattatagggataagtaagttatttataggtagtatagtgtagtgacg

SEQ ID NO: 172 - DNA, 2501 bp, Artificial Sequence
  chemically treated genomic DNA (Homo sapiens)
ttgttgtatagaatattttattatttaggtattatgtcgagtatttaatagtttttttttttgtttttttttttttttttattttgtattttggagttaattatagtgtttgttgtttttttgtttgtgttataagtttttattatttagtttttatttataagtgagaatatttagtatttggatttttgtttttgtattagtttgttaaggataatagtttttagttttatttatgtttttataaaagatatgatttagttttttttaatggttgtattaaatgaagttttaaagatataatataaatattaattttttttttattataaaaattttttgttgaatttgattatatttaaattaacgagttttgttttatgaaagattttttggataaatttgatagttgatggaataggagaagttgtttgttatgtttaaagttaataagagattaatatttagaataaatggagatttgtaaattaatagaaagtaggtagtaaagttaaagaaaatagtttaaggtatagttattaaaaggaacgtgattatgttttttgtagggatatgggtggagttggaagtcgttagttttagtaaatttatataggaatagaaaattagcgagatcgtatggttttatttataagtgggagttgaataatgagaatatatggttatatggcggcgattaatatatattggtgtttgttgagcggggtgttggggagggagagtattaggaagaatagttaagggatattgggtttaatatttgggtgatgggatgatttgtatagtaaattattatggcgtatatatttatgtaataaatttgtatattttttatatgtattttagaattttaaataaaagttggacggttaggcgtggtggtttacgtttgtaattttagtattttgggaagtcgaggcgtgtagattatttaaggttaggagttcgagattagttcggttaatatggtgaaatttcgtttttattaaaaatataaaaattagttagatgtggtacgtatttataattttatttattcgggaggttgaagtagaattgtttgaattcgagaggcggaggttgtagtgagtcgtcgagatcgcgttattgtattttagtttgggttatagcgtgagattacgttataaaataaaataaaataatataaaataaaataaaataaaataaaataaaataaaataaaataaaataaaataaaataaaaaaataaaataaaataaaataaaataaagtaatttttttttttttaagcggtttttattttttttttttgttttgtgaagcgggtgtgtaagtttcgggatcgtagcggttttagggaattttttttcgcgatgtttcggcgcgttagttcgttgcgtatatttcgttgcggttttttttttgttgtttgtttattttttaggtttcgttggggatttgggaaagagggaaaggttttttcggttagttgcgcggcgatttcggggattttagggcgtttttttgcggtcgacgttcggggtgtagcggtcgtcggggttggggtcggcgggagttcgcgggattttttagaagagcggtcggcgtcgtgatttagtattggggcggagcggggcgggattatttttataaggttcggaggtcgcgaggttttcgttggagtttcgtcgtcgtagttttcgttattagtgagtacgcgcggttcgcgttttcggggatggggtttagagtttttagtatggggttaattcgtagtattaggttcgggttttcggtagggtttttcgtttatttcgagattcgggacgggggtttaggggatttaggacgtttttagtgtcgttagcggtttttagggggttcggagcgtttcggggagggatgggatttcgggggcggggagggggggtagattgcgtttatcgcgttttggtattttttttcgggttttagtaaatttttttttgttcgttgtagtgtcgttttatatcgtggtttattttttagttcgaggtaggagtatgtgtttggtagggaagggaggtaggggttggggttgtagtttatagtttttcgtttattcggagagattcgaatttttttattttttcgtcgtgtggtttttatttcgggttttttttttgtttttcgtttttttcgttatgtttgtttttcgttttagtgttgtgtgaaattttcggaggaatttgtttttttgttttttttttgtatttttgattttttttcgggttgttgcgaggcggagtcggttcggtttttatatttcgtattttttttttttcgtaggtcgttgcgcggttttgcgtatgttgttggtagattagggttagagttggaaggaggaggtggtgatcgtggagacgtggtaggagggtttatttaaagttttttgcgtaagtgattatgttcgggtaaggggagggggtgttgggttttagggggttgtgattaggatt

SEQ ID NO: 173 - DNA, 2501 bp, Artificial Sequence
  chemically treated genomic DNA (Homo sapiens)
gattttagttatagttttttaaggtttagtattttttttttttgttcgggtatggttatttacgtaggaggttttgagtgagtttttttgttacgtttttacggttattattttttttttttagttttggttttgatttgttagtagtatgcgtagggtcgcgtagcggtttgcggggagggagaagtacgagatgtggggatcgggtcgatttcgtttcgtagtaattcggggaggggttaggagtgtagggagggaatagggaaataggttttttcgaagattttatataatattggggcggggagtaggtatggcgggagaggcggggaataggaaggaggttcggggtaaaagttatacgacggagggataagggggttcggattttttcgggtgggcgaggggttgtgggttgtagttttagtttttgttttttttttttgttagatatatgtttttatttcgaattgggaaatagattacggtgtagggcggtattgtagcgaataaagaaaagtttgttggagttcgggggaggatgttaaggcgcggtgagcgtagtttgtttttttttttcgttttcggggttttattttttttcgaggcgtttcgggttttttgaaagtcgttaacggtattggggacgttttgggttttttaggttttcgtttcgggtttcgaggtgggcgaggagttttgtcgggagttcgggtttgatgttgcgggttggttttatgttgggagttttgagttttattttcggggacgcgggtcgcgcgtatttattggtggcgaagattgcggcggcgaaattttagcgaaggtttcgcggttttcgagttttataagggtggtttcgtttcgtttcgttttagtgttgagttacggcgtcggtcgtttttttggagggtttcgcggattttcgtcggttttagtttcggcggtcgttgtatttcgggcgtcggtcgtagaggggcgttttggagttttcggagtcgtcgcgtagttggtcggggaagttttttttttttttttaggtttttagcggggtttagggagtaaatagatagtaggaagaggatcgtagcgaagtgtgcgtagcgaattggcgcgtcgggatatcgcggggggaaattttttaagatcgttgcgatttcggagtttgtatattcgttttatagggtaggggagaggggtggaggtcgtttagaggaaaggaaattgttttattttattttattttattttatttttttattttattttattttattttattttattttattttattttattttattttattttgtgttattttattttattttatgacgtagttttacgttgtggtttaggttggagtgtagtggcgcgatttcggcggtttattgtaattttcgtttttcgggtttaagtaattttgttttagtttttcgagtaggtggaattataggtgcgtgttatatttggttgatttttgtatttttagtagagacggggttttattatgttggtcgggttggtttcgaatttttgattttaggtgatttgtacgtttcggttttttaaagtgttgggattataggcgtgagttattacgtttggtcgtttaatttttatttgaagttttggggtatatgtagaggatgtgtaggtttgttatataggtgtgtgcgttatgatggtttgttgtatagattattttattatttaggtattaagtttagtattttttagttattttttttggtattttttttttttagtatttcgtttaataggtattagtgtgtgttgatcgtcgttatgtgattatgtgtttttattgtttagtttttatttataagtgagattatgcggtttcgttggttttttgtttttgtgtgagtttgttgaggttaacggtttttagttttatttatgtttttgtaaaggatatgattacgttttttttagtggttgtgttttaggttattttttttggttttgttgtttattttttgttgatttgtagatttttatttattttagatattgattttttgttggttttagatatgatagatagttttttttattttattaattgttaagtttgtttaaggagttttttatgaaataaaattcgttaatttaagtgtaattaaatttagtaagggatttttgtggtggggaagaggttggtgtttatgttgtatttttaaaattttatttaatgtagttattaaaaagaattagattatgttttttgtgggaatatggatggagttagaggttattatttttagtaaattaatgtaggaatagaaatttaaatattggatgtttttatttgtaagtgggagttaaatgatgagaatttataatataaataaggaaataatagatattgtggttgattttagggtgtaggatgggaggaaggagaggagtagaaaagagaattattgggtattcggtataatatttgggtgatgaaatattttgtataataa

SEQ ID NO: 174 - DNA, 2501 bp, Artificial Sequence
  chemically treated genomic DNA (Homo sapiens)
ttagagtttgaagttttgtattaggcgtgcggtgttttaggagtaggagttttacggtttttaatagaaattttgatgtttagggagatttttgtgagtgtttttgacgtttagggggtatttttggtttatttttcgaaggaggcgtgtgatgggaaaggtagttggtgtggatgttttgggatatcgtacgtgtttagaaacgcggcgggaaggttaaagttttagagtaagcggttgggttgttgatttaggagtgtgtttttttggtttgaggttgggcgtttttatcggttattttaggggtttgattaggtttgaggaagttttttttagttatttattgaagtagaagtcgcggtttttatagacgaattggagggtgtttattagtttttcgtcgtatagggttttattggggcggtaagtagtaatgtagtacgaggcgaaggttaagaaggtgagaagtattagtatcgatttttttattgggatttttattggtgtttgggggcgggagagaagtggcgtgagcggggtagttaggttaagttttaggttagaggtgttttttttaaattaaatttgttaatttataaatttagttgaaaattgaaagtacggtttttttataaatattatttttattataaaagtaatatataggttataatgtcgaggtgagggcgtagggttatgtgtagaatgaagcgtttagaagtatatagaaaaggtttagttttttttatttgtaagaagtattagtaattttatacgaggggtgattatttttacggttattattgtaggagtttagcggtatttatagttgtaggggtttaggttggatattcgatttggttttcgttttatgatattatgggggtagggttagtttagcgttatatcgttattttttaggtttttagcgttagttaagatggtagatagttttatttttatagagtatgtgtatttaggaggattagtttttttttttttataatttttagttgagtagggggggtttaggaggattatcgtttttaaagtagtaggttagttttgttgggttagtttcgtttttttttttggtttttttatttttttagtttgtagttgagttaggtttgggttaaggattttaatggttaatataattacgttatttatgttttagaaattttgtttttttagttatttagttttttaattttagtttgttttgggtatttttaaatatatatatatacgtttagagttttttttttaggttttaaatcgaattagtaaggttaggggtttttagaatatttttttatttgcgttattaaatttttttcgtgggagttggagagattagtttaggttatttgggaagttcgatattaggttttttagattataatttggaaggggaggttagttttaggatatattttttttataggttgtagggttatagggtcgggttaatttattcgggggtgggaggtcgggagttattatagtaagttggttttgtttttgtagaaggtggaattttttaggcgggtagttttagttttcgtttcgtagatttaggggagtttttgatgtaataaattatgtgagcgattgagtaggtagtgggatagaagtataattttgtatgttttttttaaagattagtgggtagttgcgtcgaggatttgaaagtttttttggttatttttttgattggattttggttagtttttttatcgttttttttgttatttttttttaaattttaagagtatatttcgttagttggttattttagttttcgtcgcgttttcgtaataagttttattattttgaatttggaggttcgggttaggggatcggtagaaagtaggataggaagtatgtagcggtgcggagtaggtgagggtttaggaaaagttttgagttgggtaaggagggggtcgaagggaaggaatagaaagggaaggagtaggtgagggagtagagattaggtgggggtaggggtagaggaaaagaggggaggggggtgttgttcgagaggtagcgggttggcggttgtagggttcgaggtttaggcgtgggtcgtgttttttgttgttttgttttaggttggagtgggatggtagcgggggtttttattttatagttttggttatttatagtttagtagaaggttcgttggggtaggaggaggaggaggaagaggaggaggaggaagttggaagttttttttataggagaagttaatgtttagtttgtaggttggttagtgttttagtttttatgtgtgagtcgattttttttagttcgggttttattttattttttatttttttttttgttgattattttttcgcgtttttgttttcgttttttttttttttttagttagtttttttttttttgtatttttaatcgggagttttggattatttcgtagcgaagtgttatgggtttttattttgtattttcggtttatttttgtatagggt

SEQ ID NO: 175 - DNA, 2501 bp, Artificial Sequence
  chemically treated genomic DNA (Homo sapiens)
gttttgtgtagagatgagtcgggggtgtaggatgggagtttatggtatttcgttacgggatggtttagggttttcggttgggggtgtaggagagaagagattggttgggaggagggagagggcgggagtaaaggcgcgggggagtggttagtagggagaggggtggggggtagggtggagttcgggttgggaggagtcggtttatatataaaagttgaggtattgattagtttgtaaattggatattagttttttttgtgaaagagatttttagtttttttttttttttttttttttttttttttttgttttagcgagttttttgttgagttgtaggtaattagggttgtggagtgaggattttcgttgttattttattttagtttgaggtagggtagtagggggtacggtttacgtttgggtttcgggttttgtagtcgttagttcgttgtttttcggatagtattttttttttttttttttttttgtttttgtttttatttggtttttgtttttttatttgttttttttttttttgtttttttttttcggttttttttttgtttagtttaggattttttttgggtttttatttgtttcgtatcgttgtatgttttttgttttgttttttgtcggttttttgattcggatttttaagtttagagtggtggggtttgttgcggaagcgcggcgagggttagagtggttagttggcggagtgtgtttttagaatttggaagggggtggtagagggggcggtgagaggattggttagggtttagttaaggagatgattaaggaggtttttagattttcggcgtagttgtttattagtttttagagagggtatgtaaagttgtgtttttgttttattgtttgtttagtcgtttatataatttattgtattaaaaatttttttgggtttgcggagcgaaggttggggttgttcgtttggagggttttattttttgtaggggtagggttaatttgttgtggtggttttcggttttttattttcgagtgggttaattcggttttgtggttttgtagtttgtggagggggtgtgttttaagattggtttttttttttagattgtagtttggggaatttggtgtcggattttttaggtggtttgagttggtttttttagtttttacggggagagtttggtagcgtaaatagggagatgttttggaggtttttggttttattggttcgatttgaggtttggaaaggaggttttgggcgtgtgtgtgtgtgtttgggggtatttaaggtagattggagttggagaattgggtgattgggaaaataaggtttttagagtatgggtggcgtggttgtgttaattattggagtttttgatttaggtttggtttagttgtagattggaaaggtggaaaagttagggggaggggcggggttggtttagtaggattggtttgttgttttgagggcgatggtttttttggattttttttgtttagttgggggttgtggggaggaagggattggtttttttggatgtatatgttttgtaggggtggggttgtttgttattttggttggcgttggaggtttgagaagtggcgatgtgacgttgggttggttttgtttttatggtgttataggacggaggttaggtcgggtgtttagtttgggtttttgtagttgtggatgtcgttgagtttttgtaataatgatcgtggagatggttatttttcgtgtaaaattattagtgttttttgtaaatggaaggaattgggttttttttgtgtgtttttggacgttttattttgtatatggttttgcgtttttatttcggtattatgatttgtgtgttatttttgtaataaaaataatgtttataggaaagtcgtgtttttaatttttaattgaatttgtaggttggtaaatttggtttgggaggggtatttttggtttggggtttggtttggttgtttcgtttacgttatttttttttcgtttttagatattaatgggaattttaatggggaagtcgatgttggtgttttttatttttttggttttcgtttcgtgttgtattgttgtttatcgttttagtgagattttgtgcggcggggagttggtggatattttttagttcgtttgtggggatcgcggtttttattttagtaagtagttgggaggggtttttttagatttggttaggtttttagagtgatcggtgaggacgtttaattttaagttaggggagtatatttttaggttagtagtttagtcgtttgttttgagattttgattttttcgtcgcgtttttgagtacgtgcggtgttttagggtatttatattagttgttttttttattatacgtttttttcgaagggtgggttagaggtgttttttagacgttaggggtatttataggggtttttttgggtattagaatttttgttgggggtcgtgaggtttttgtttttgaggtatcgtacgtttagtgtagggttttaggttttgg

SEQ ID NO: 176 - DNA, 6009 bp, Artificial Sequence
  chemically treated genomic DNA (Homo sapiens)
atatagtatcggtttttgtttttgggttttttttttattcgcgtttatatattcgtattttaattaatataaatagtttaagtttttatagtttggaggcggtcgtcggagtagggttttagcgtatcgcgagtttttgtttttttcgttttgtagcgtcgcgagtttttttttttttcgcgtttggtttcgtttgcgtttttttcggcgtgggtattcgtagattcgttaggaggttgacgagaggtgtttttatagagttttgtttttttttagatttttaaacgaaaagaaagagaaaagttaatttttcgtttttattttgtacgtatttggagagcggttggtggcgagcgattcgtataatcgtttttttcgcggcgtttttggacgggcggagagaattcgggtgattgagtttgaggttgagtttttttgggagcgatttatgttagttatttttatttttaagggggattcgcggtcgggtttacgcgcgaaggatgggtgttagggaaattgatttatagacgattcgtttcgcgagagattgataatttagttttgcgggttttcggggcgtttagattagtttttagttagaggatttggggttgtatagttttcggattttggagggggtggttcgggggtgggagattgcgagtattagtttacgtcggtttttttttattttgcggcggcgaggtgggaagggttaggatgcgagtttagtattttttttagaaatgtagtatttcgtttttttattttttttgttttcggcgtttttttttttacgcgttttttttcgttttttttttaagggcgttttttttttgtttttagtttacgtttgaatttttcggcgttttttttttttttttttagttttttttttacgttttttgttttcgggtattttttttttttaattttttattttcgtatcgtttgatttcgaggggcgggagcgtattgggttgcgtacgggtgggggcgtcgcgttagtttcgcgtagttgttttgacgtcgttgtcgtcgtcgtcgtcgtcgtcgtttttcgtagtttagttcgcgtttcgcggtagtttcgtagtgtattagttattatcgtcgtcgtcgtcgtttcgttagatttgttgttagtttgttcggtttagttttgagagagtttcgaacgttagttgcgagggttatgagttagagagtttcggggcgtcgcgcggagagtaagcggagatagcgattttgcgttttttagttttcgtttttttgtatcgcgtttttcgtattttcgggtttttttgtttttttcgttgtttttatcgtcgttatggttattttgtttcgtagtaagttgtttaacgtggttacgttcgtgtttaataagttttaggttaagatgagcggtatgttcgttaggatgggtttttaggcggttacggatgaggaggcggtgggtttcgcgtattgcgacgatttcgattttgagtatcgttagggtttgtagatggatattttgaaagtcgagggagagttttgcggggacgagggcgttgaagcgttcgtcgagggagatatttattattagcgaggtagcggagtttttttgtcgtttttcggttttaaggattaggtgggaggtggtggcgaattcgggggttacgataagtttaaaattacggcgtgggaggtaggttggaacgtgattaacgttatttaggtaagcgcgggatttttagttttgtttgttttttttttttttagtttagcgtgtcgggttttgttttcgatagtcgttcggtgatttcggtttggagatttttttttgtatttaggaatttttttttttttattttttttagttttgcgcggggatttacgtttttaggcggtgtttttcgttttaatttacgtttttttttaacggtattagttgtaagatcgttaggttgaagttcggtttgagatatttgttcggagatattgtaaaagtgaaggaaatggggggagggagtaggaagcgatgagaaagaaagaaaattaggattggagggtacggtttggttttggattttggaacggatttatagttgtatttttgggaggaaagaagaaggggaaatcgttgaggtcggagtttttttttttcgtatatacgtatagatacgtatacgtatataggtaggtatattatatgtttatagtttttttttttacgaataaaggcgtaggtataggcgtatacgatatgtatttatatatagattatagtattatttttaaatgtatttgcgtatatttttatagttttataaataaaagtatatatttgtatatattaaatatacgaatattcgtttgaatatatgtatatatatatgtatagatgtatgtagataggaattagtttgtttttttgggtgcggttttgttggagatatataggtatatatatacgaaagtatatatatgtttttatataaatatatttagttcgtaataatttagtattatttgtgtatagattcgtttttttcgttcgaaatttcggttgtatcgtaaagaggcggttagttttttttcgtgtgattttggcgaagttttttttagaggttaagaatggtttttgttttttaggttttttttttttatttttaattttttattttttattaggcggcgtaggatttttatatagggagtaggtttggagttttggtaacgattttcgagttagtaggggttggtaggtcgtagttttttgggtcgaaggagattttagttttaggtaatttcggttttttatagtttggtttcgcggcgtttttggagcgtattattattggggttacggaaggtaggttttttgggagtagaggttttttaggggttgttttatgtatcggggtaagtaggattttatcgggtttcgaatattagatggttcgatttaaggcgtttttcgtttcggggttcggcgagacggttttgttggattacggattcggggttgttttcgttttcgttgtgtttcgcgatttttcggggcgttttttaaggtttcgtttgataggttttaagggaggttagggtaggaggttggaggttcgtaggttttcgggattttggatttcgttagtttttagttttcgtgtggattttaaattttatagttttgttcgtttgattttgaagtttttggttttagatttttgttcggttcggttttttggtttttttggcgttttttcgttaagtttttttttttgtttgtttttttagtttttatttagtttttttttttaggtttcgttttcgttttattttaattttagttttgttttaagatttttaatttttagttttgttttttttttttcgcgcgttgttttttaagcgtttttatattgtttttgtttttgttttttaggggttttgttttatttttagtttttttttttttttattttatttttttttcgttttataattgtagtttttaacgtttttttttttggtttgagtttgagacgttcgagtttttttttttagttttcgtgttttattttagttttattataaatttcgtgtttattttttttattggtttaggtttagtttattattttttttagagttttttttcgattacgtttttttttgtttttttttatttttttttttaattttttattttgtttttgtttttagaaattatttcgaagtatttttttttttttttgtggtttttttttatttttagtttttttttattttagttttttcgttattattagttattagcgtattttttttttttagattcgtttatatatttttttttttttatttttggttcgatattcgggtttattattagtttttttatatttatttcgtagtttgtttttaatttttttttttcggcggtttagatttaatttttagtgtttttagcgtttttttcgggttatagcgttaagttacgtttttcgggttttttattcgttgttaagttcgttgagcgttcgcgtttggttgttttttcgttttatagggtatgttcgtgttgggtttattttacgttattttgtacggcggttatttggggttgttttttattattttcgtcgtcgttgtgtgttgttatatcggtaagatttttatcgcgtgtttgtacgaggagaatgaagacggcgaggtggtgcgcgtgcgggattcgtacgtggttatagttaacgtttgttgcgtttcgcgttttttaacgttgggcggtcgagtggtgaacgtagcgtagattatcgagttggtgatgacgtgtattttgtacgtggtggtgagtggtaattttatgtataatagtttttcggggttgttcgtgtcgtagaagttttggtttattatcgttacggtcgtgttgttgttttgcgttttttttaagaattttaaggtcgtgtttaagtttagtttgttgtgtattttggtttatttcgttattaatattttggttatagtttattgtttatcgcgggcgcgcgattgggtttgggagaaggttaagttttatatcgacgttaagaagttttttatttttattggtattatcgtgtttagttatacgttttagatttttttgttttcgttggagggtaatatgtagtagtttagcgagttttattgtatgatgaattggacgtatatcgtagtttgcgtgtttaagggttttttcgcgttcgtcgtttattttatttgggtcgacgagattaaggaggttattacggataatttgttcggttttattcgcgtcgtggttaatatttttttggtggttaaggcgttgttgttttattttttgttattttttgtcgttgtcgaggtgttggagaagtcgtttttttaggaaggtagtcgcgtttttttttcggtttgttatagcggcgacgggcgtttgaagttttgggggttgacgttgcgttgcgcgttcgtcgtttttacgttgtttatggttatttatgtgtcgtatttcgcgttgtttatgggttttatcggtagttttacgggcgtcggtttttgttttttgttgtttagttttttttatttgcgtttgttttggcgtaagttgttgtggtattaagtttttttcgacgtcgttattttcgttatcggcggtatttgtagcgtgttcggtttcgtgtattttttcgagggttttatcgaagtttatcgaattaacgcggaggattagggcgtaagggcgagttttcgtcgcgtttttgcgtttttttttttttttttttatttcgtttttattagtttagtgcgttttgtcgtcgcgtttgggaggttaagttttaaatatttttggtttttagtttttgattattcggggatgggggggatgggaggggatagggatttacgatttatcgcgtttgcgtttttgttgtttttttttttttataatattttggttttggggggaggcggggtgtatttgcgggtagggttttttgtttttttaagtggggtttcgatattttggttttagttatcgagggggttgggaagggagggagagggggcgtagttcgtaggcgtggtaatttgattttgggggaatattttatatttatttagagttcggaatttatagcgtttagttatttttagtaagagcgttttttatttcggagacgttttaattttgtagcgggaaaggttgattgggaaatttattttgggtgggtaattttttttaacgaagtcggaaggcgagaagtcgcggcggggttagtttgtttgtcggtttttaggaatttaaatttttattttgtgtaatttattaggtgtggaattgttttattgtgcgtgtggtgtgttcgtggtgaataagatgaaatgtatattagaaaaaaatttatttttaatttagagtgcggtatataattatattcgtaaataaagaagagataaaggtttgcgcggttcggtgtcgggtttgtg

SEQ ID NO: 177 - DNA, 6009 bp, Artificial Sequence
  chemically treated genomic DNA (Homo sapiens)
tataaattcgatatcgggtcgcgtaagtttttgttttttttttatttgcggatataattatgtatcgtattttaaattagagatagatttttttttgatatatattttattttatttattacgagtatattatacgtatagtagaatagttttatatttgataaattgtataagatgagagtttagatttttgaaaatcggtaggtaagttggtttcgtcgcggtttttcgtttttcggtttcgttgaaggaaattgtttatttaaaatggattttttagttagtttttttcgttgtagggttgaaacgttttcggaatgggaagcgtttttgttggaaatggttggacgttgtagatttcgagttttggatggatgtgaaatatttttttaaggttaagttgttacgtttgcgagttgcgttttttttttttttttttttaattttttcgatgattggaattaaagtgtcggggttttatttggaaggatagagaattttgttcgtaaatgtatttcgtttttttttaaaattagggtgttgtggaaaagaaaggataatagaaacgtagacgcgatggatcgtgaatttttgtttttttttattttttttattttcgaataattagaaattaggaattagagatgtttaaagtttggttttttaagcgcggcggtagggcgtattgggttggtgggggcggggtgaggggagaagggagagagcgtagaagcgcggcgggggttcgtttttgcgttttagtttttcgcgttggttcggtaggtttcgatgaggttttcgagggagtgtacgaagtcggatacgttgtagatgtcgtcgatgacgaagatggcgacgtcgaagaagatttggtgttatagtagtttgcgttagagtaggcgtaggtgaaagaggttgggtagtaagaaatagaggtcggcgttcgtgaggttgtcggtgaggtttatgagtagcgcgaagtgcggtatataaatggttatgagtagcgtgaagacgacgagcgcgtagcgtagcgttagtttttaggattttaggcgttcgtcgtcgttgtagtaggtcgggaaaaaggcgcggttgtttttttggaagagcgatttttttagtatttcgatagcggtaaagaatggtagaggataggataatagcgttttggttattagaaagatgttgattacggcgcggatggagtcgggtaggttattcgtgatgatttttttggtttcgtcggtttaggtgaggtaggcgacgagcgcgaagaggtttttgagtacgtaggttgcgatgtgcgtttagtttattatgtagtggaattcgttgggttgttgtatattgttttttagcgaaggtaggaagatttgagacgtgtagttgaatacgatgatgttaatggagatggggaattttttgacgtcgatgtagaatttgatttttttttaggtttagtcgcgcgttcgcgatagatagtaggttatgattaggatattgatgacgaagtgggttagagtgtatagtagattgaatttggatacggttttgaggtttttaaggaaggcgtaaggtagtagtacggtcgtggcgataatggattaggatttttgcgatacgggtagtttcgggaagttgttgtatatgaggttgttatttattattacgtataggatgtacgttattattagttcgatgatttgcgttacgtttattattcggtcgtttagcgttgggaagcgcggggcgtagtaggcgttggttatggttacgtacgagtttcgtacgcgtattatttcgtcgtttttatttttttcgtataggtacgcgatgaggattttgtcggtgtagtagtatataacggcggcgaagatgatgagaaataattttaggtagtcgtcgtgtaggatggcgtagggtaggtttagtacgaatatgttttgtggggcggagaggtaattagacgcggacgtttagcgaatttggtaacggatgaggggttcggggggcgtggtttaacgttgtggttcgaagggggcgttaaggatattgagaattgggtttgagtcgtcggggaggagaggttaagagtaggttgcggggtggatgtaggggaattaatagtgagttcgggtgtcgagttagagatggagagggagggatgtatggacggatttgagaaggaaaggtgcgttaatggttggtgatagcgagagggttagggtgggagagggttgagaatagggagaagttataggagggaagggagatatttcgggatggtttttggggataggaatagaatgaggagttgggggaggagatgagaagggatagaagggagcgtagtcggaaaggggttttaagaaaggtagtgagttgggtttgggttagtggaaagagtgggtacgggatttgtggtggggttggaatggggtacgggagttaaagaggaaaattcgggcgttttaggtttagattagaggaggaaacgttaaaggttgtagttgtgaggcgaaaaggaaatagggtagagagggagaggggttgaaggtggggtaaagtttttgggaggtaagaatagagataatgtgaagacgtttggggagtagcgcgcggggaggaggaagtagggttggaaattgagagttttaggataaggttggagttagagtgaggcgagggcgagatttaaggaaggggattaagtggaggttggggaggtaagtaggaggaggagtttggcgggaaggcgttagggaggttagaaagtcgaatcgagtaagagtttagaattagaagttttagggttaggcggatagggttgtagggtttagaatttatacggggattaagagttaacgaaatttagggtttcggaggtttacgagtttttagttttttgttttggttttttttggggtttattaaacggagttttgaaagacgtttcgggaagtcgcggggtatagcgaaggcgggagtagtttcgggttcgtgatttagtaaggtcgtttcgtcgggtttcggagcggaaagcgttttgggtcgggttatttggtgttcggggttcggtggagttttgtttatttcgatatatggaataatttttgggaggtttttgtttttagaaaatttgtttttcgtggttttagtgatagtgcgttttagggacgtcgcggggttaagttgtaagggatcggggttgtttagagttgaagtttttttcggtttagaaagttgcggtttgttagtttttgttagttcggaggtcgttgttaagattttaaatttgttttttatgtaggagttttgcgtcgtttggtggggagtggggggttaggaataaggggagagggtttagagagtaggggttatttttagtttttggagagggtttcgttagggttatacggggaggagttggtcgtttttttgcggtgtagtcgggatttcgggcgagaggggcgagtttgtgtataggtaatgttggattattgcggattaaatgtgtttgtgtgggagtatgtgtgtgttttcgtgtgtgtatatttgtatgtttttaatagggtcgtatttaagggagtaggttggtttttgtttgtatgtatttgtgtatgtgtgtgtgtatatgtttaaacgaatattcgtgtgtttggtatgtgtaggtatatgtttttgtttgtggagttgtaggggtgtacgtaggtgtatttggggatagtattgtggtttatatatagatatatgtcgtgtgcgtttgtgtttgcgtttttgttcgtgggaaggggggttgtgggtatgtggtgtgtttgtttatatacgtgtgcgtgtttatgcgtgtgtgcggggggaggagatttcgattttagcgattttttttttttttttttttttaaaaatgtagttgtgaattcgttttagagtttaagattaaatcgtgttttttaattttgatttttttttttttttatcgttttttgttttttttttttattttttttatttttgtagtgttttcggataggtgttttagatcgaattttagtttagcggttttgtagttggtgtcgttgggagggagcgtgggttagggcggaaaatatcgtttgggggcgtaggttttcgcgtagggttgggagggatggagaaagggagatttttgggtataggagggggtttttaggtcgagattatcgggcgattgtcgggggtagagttcggtacgttgagttgggaggggggaggataggtagaattgggaatttcgcgtttatttggatggcgttggttacgttttagtttgttttttacgtcgtgattttgggtttgtcgtggttttcgaattcgttattattttttatttggtttttggagtcggagggcggtagaggagtttcgttgtttcgttgataatggatgtttttttcgacgggcgttttagcgttttcgttttcgtagggttttttttcggtttttaggatgtttatttgtaggttttggcggtgtttaaagtcgaggtcgtcgtaatgcgcgaagtttatcgtttttttattcgtggtcgtttgaaaatttattttggcgaatatgtcgtttattttggtttgggatttgttggatacggacgtggttacgttggatagtttgttgcggagtaaggtggttatggcggcggtggggatagcggaaaggatagaaggattcgaggatgcggggaacgcgatgtaagaaggcgagggttggggggcgtaaagtcgttattttcgtttgtttttcgcgcggcgtttcggggttttttggtttatgattttcgtagttggcgttcgaggtttttttagggttggatcgggtaagttggtagtaggtttggcggagcggcggcggcggcggtggtggttagtgtattgcggagttgtcgcggggcgcgagttgggttgcggagggcggcggcggcggcggcggcggtagcggcgttagagtagttacgcgaagttggcgcggcgtttttattcgtgcgtagtttaatgcgttttcgtttttcggaattaggcggtgcgggggtgggggattggagagaggaaatattcggaggtaggggacgtgaggaaggggttaggagaagagaaagggggcgtcgagggatttagacgtgagttgggggtagaagaagggcgtttttgggaaggaggcgggagggagcgcgtgaaagagggagcgtcgagggtaggggaggtgggggggcgaagtgttgtatttttaggggaggtgttaagttcgtattttggttttttttatttcgtcgtcgtagggtgggagggggtcggcgtgggttgatgttcgtagttttttattttcggattattttttttagggttcgggagttgtgtagttttagattttttggttaaggattggtttgggcgtttcgaaagttcgtaggattgagttgttagtttttcgcggagcgggtcgtttataagttagtttttttggtatttatttttcgcgcgtaaattcggtcgcgagttttttttgaaggtagaagtggttggtatggatcgtttttaaggaagtttagttttaggtttagttattcgggtttttttcgttcgtttagggacgtcgcgagggaagcgattgtgcggatcgttcgttattagtcgttttttaaatgcgtgtagaatggaggcgaaaggttggttttttttttttttttcgtttgggggtttggaagaaggtaggattttatgaggatatttttcgttagttttttagcgggtttgcgaatgtttacgtcgagaggggcgtagacggggttaggcgcggaggaaagaagggttcgcggcgttgtaaggcggaggaagtagaggttcgcggtgcgttggggttttgtttcgacggtcgtttttaggttgtgaaagtttgggttgtttgtgttgattggggtacgggtgtgtgagcgcgagtaagggagagatttagagataaagatcgatgttgtat

SEQ ID NO: 178 - DNA, 2299 bp, Artificial Sequence
  chemically treated genomic DNA (Homo sapiens)
gttggttatggggttttgattttgattataaggttagggatttgtttgggattagtggatagatgtttttagtaaagttattagggttttaggggttagataggaaatttttttttttttttttttttttgtggtttttttgtttttattaagatagtttttaggatttgggggatagttagtttgaggtttttttttaaatgaaagaagtttagtttggtttttaggaagtgtgtggatatttttggagttgttgttttttggagtgggtttgtgattttagagttttatgtttttagtgttgggatggggaggtttggggagttaggttaggtgggggtagtttttatttgggggggtatagtaggtagtgttagtttggttaggagttgtaggaagtaagggaatagttttatgattggtatttttttagatgttttgagttagggggttttgagggaaaattattatgtttattttttggggagtttttggtataggaggagaagagttgagtggggggttggatgttttttttattgttgttttgaggttttggttggtggtttgagtattttttggaagttttgtggagttaggagtttgtaggtaaggttgtggttggggaatttgatggggagtggtttggtggggtggggtgttgaggggtaggtgggttttggggatggtttgttgggtgtttagtgttattttaggtttttttgtagttgggtggttgtttgttgatgtagttttttttgtagatagtagtttttttttgagattgtagttggtttgtgtttgggttttagggattgagttggggtggggttttgggttggttttgtttattgtagatgaggtttttgagttgagtttttggagtgtttggttagtttgtagtgtttggttagtttgtagtgttggagtttgtagtgtgtgtgaggggtttttggtaggtttagatgttttgttgagtttagtttgtagttttttgggttgtgttgtgtttgtttatagggtttatagttttgttttggtttttagggtggttatttgggatgggggtatttaggagtttagtgttagttgttaaggtttatgatttaattgtttttgtaggaagggttgtttgggatgtttgggaaggtagttatgtttatatttttagggggttaagggatttttagttaggttatatagatgaagaaattgaggttttgagagtatttttgtttgtatatgttgaatggatataggtatttttggaaagtgtgtgtgtgttgtgtgtgtgtgtgtatttgtgtgtttgaggaattggtagagataaaatttaagtttatgtgattttagaattttaatttgatttattatttttttagttaggtatggatatagtgggttttttataggaaattttttagggtatttggttggaggattaggtttgttgtttttttgggaagtagtttttttaggttttttttgtggggtagttttttgtggtagagagtggttttatttaggtatttttttttggtttttggttgaggaggaattgtatgttgtgtgggggtttgtgtgtatttgtgtgtgtgtatgggtatttgtgggtttgtgaatatttatgagtggtgtatttgagtttttgtgtggtttgagtatgtgtgattattgtatttttaaatatgtttttgtgtgggggttaggtttttttgtatttttgtatgtttgtgtgatttgtttgtgtttgttgtgtatttgggtgtgtttggaagtgtttgaatgtgtattttttggtgggattgtgagtttgtatgtttgtttgtttttgtgtgtgtgtgtttgtttttgtgggtgaagattgtgtttttttttttgtgtttgtgtgtgtttttttttggttttggatttttttttattattattttttttattgttttttgtgtttagtttttaggttgtaggaatttggtaggattgggagttatgagttggttgggtttggggttggtgggtggttgtgggggaggagtgaggtttgggaagtggtttttatagtttatattttagttaagagtagggaggttagggtagttttagtttttattttagtgatttttgtgtttattgtttgtttgtttgtttatttatgaggggttgttagagatgtagtttgtttgtttggttggttttaagtttggaggtttaggaggtgggggttagttattagttggttaagtggggtttgtaaggaatattttgatgagttttaaataagttggggtttgtggggtag

SEQ ID NO: 179 - DNA, 2299 bp, Artificial Sequence
  chemically treated genomic DNA (Homo sapiens)
ttattttatgaattttagtttgtttgaagtttgttaggatgttttttgtagattttgtttagttagttggtgattggtttttgttttttgaatttttaggtttagggttggttaggtaggtaggttgtatttttggtagttttttgtgggtgggtaggtaggtaggtagtggatgtagaggttattggggtgagagttggggttgttttggtttttttgtttttggttggaatgtgagttgtaggggttattttttaggttttgttttttttttatagttatttattagttttaggtttagttaatttgtgatttttagttttgttaggtttttgtagtttgggagttggatatagaaggtagtgagaggagtggtggtaaagaaagatttagaattaagggagggtatatataaatgtagagagagaggtatagtttttatttatagagatagatatatatatgtagagataggtaggtgtgtagatttatagttttattgaaagatatatatttagatatttttaaatatatttagatatatagtggatatgaatagattatataagtatatagagatatagagagatttgatttttatatagaggtgtatttggaggtatagtagttatatgtatttagattatatagaggtttagatgtattgtttatggatatttatagatttgtaaatgtttatgtatatgtgtagatgtatatagatttttgtgtagtgtatagtttttttttggttagggattaggaggagatgtttgagtgagattattttttattatagggggttgttttgtagggagggtttgggaagattgttttttaaggaggtaataggtttgattttttagttaggtgttttgagaggttttttgtgggaggtttattgtgtttgtgtttggttaggagggtggtaggttgggttagagttttggagttatgtaggtttgggttttgtttttgttagttttttggatatatagatgtgtgtatatatataatatatatatattttttaagaatgtttatgtttatttgatatatgtaggtaggggtgtttttggagttttggtttttttatttatataatttggttaggaattttttggttttttaggggtgtgggtatggttgtttttttaggtattttggatggttttttttgtagaggtggttagattatgagttttgatggttgatgttggatttttggatgtttttattttaggtgattgttttgagagttgaagtagggttgtgggttttgtgggtgggtgtggtgtggtttggggagttgtgggttgggtttggtgaggtgtttggatttgttgagagttttttgtatgtattgtgggttttggtgttgtgggttggttgggtgttgtgggttgattgggtgttttgggaatttggtttgggaattttgtttgtggtgggtggggttggtttggagttttgttttggtttagtttttgaaatttaggtgtggattggttgtagttttagaagggagttgttgtttgtggaggaaattgtattgatggatggttgtttagttatgggaggatttggagtggtattgggtgtttgatggattatttttgggatttgtttgttttttggtgttttgttttgttgggttgttttttgttgggttttttagttatagttttatttatgggtttttgattttgtaaggtttttagaagatgtttgaattattggttggggttttggggtagtagtgagggaggtgtttagttttttatttagtttttttttttttgtgttaggggttttttgggggatgagtatggtggtttttttttggagttttttggtttgggatgtttgagaagatgttggttatgaggttgtttttttgttttttgtagtttttggttgggttggtgttgtttgttgtgtttttttaggtaagagttatttttatttagtttggttttttagatttttttattttagtattggaagtatgggattttgaaattatagatttattttagggagtagtaattttaaggatgtttatatattttttaaaggttaggttggattttttttgtttgggaagagattttaggttggttgttttttaggttttgggggttgttttggtgggggtagggaagttatagggagggagggagggagggaggttttttgtttggtttttggagttttggtggttttgttaaaagtatttgtttattaattttaggtgggtttttggttttgtggttagggttgaggttttatggttaat

SEQ ID NO: 180 - DNA, 2428 bp, Artificial Sequence
  chemically treated genomic DNA (Homo sapiens)
atagtgatttgagaaagttgtttttaagtttttttttttttttgattgtatgatattatttttataattatatttttaaagtttgttttttttaaatattataagatttatgtaatttaagtagtgattttaggggtttttgtatattttatattaattttagaaatatgtttatgattattttattaaaattattaattgttatataaatatttgtttttttatgagttgtaaaataattgttattatttttatttaattaattattttgtatttttttttgattaatttttgaaaaataatatttaatattaaaggtatttttttttatttagggttttagatagtaagatgttttttttttaaatagtaagatgtttttttaagttttatggaaagtatttttttgatattagtttggggaggttgaattttggagtttttatttgaagagtaaagtattgtatttagtaatgtgtgttttgggaattaagtttaagtagttttggttgtttttttgtttaggttggtattgtttgtgtttgttagtttttttgtgaagttagtttatttgtggattaggttaaatttttggagattttatgtagatgtgggtgtagtttgttttgggatttgaagtttgttggagtttgagtttttgtattatttgggtggagttttttttgttgttgttaaaggattttgtttggatgtttattttgttattgttgtttattttgtagttgtagaatggtagtaattgttatatatttaagtaatttggttggttatttgttttgtagtttttgttagtgtgttgtttaagttggtaattaaaagtttgggaaagtgtgaaagtgttatgtgttttgtattttgtttagttgttgtgtagtttttttttggtttttattgggagataggggatttttatgagaaggaaggagtagggtagtgattgtttagtttattttgggatgtgggagttgtttttgtggattgagtggtgtggagaggggattattgagattgggaagggttatttagataaataaggaggggtgtgggtgggtgtgtagtgttttttgtttggtttttagatttatttgtgtgtgtgtaggtgtgtgtttttattttttttttttttttattgtttggagtgatgataattggtttttaaagtggatgagagatgagttatttatatttaatgagggaaaaatagtttttagagattttttgtttattggttagtgagagtgttaatttttaggtttttgttgtatgtgggtgagtttttttaggtgggaaaagtttagttgagagatataagagagtagattttttagtatttgtgaatttagagtggtgggtattgatgggtatgtgtattgtgtggatagattttttagttttatgagtggtttttttttttttgggttggatttggagtttttaagaggatggttgataagggtagtaggtagaaggattttagtttaaagttaaggaggttttggatggggagttgggtagttgtttgttgtaattttttttttgttttagttttaaaggttaagagttgtatttttgaaaagatatttggagattatttgggtgtttttgaattttaagagggttgtttgattttggtgggttttttttttatttggtgttttttttgtttgtagaaggagattaggtttggttaagtagagtagaaattatttattgattaaggaatggagtaggagagtttttgtttaaagtgtttggggtgtagtgtgggggtgttttttaaggttttttagggtatgtagttggaaagtaaggatttttggaaagagatggggttttttagaattagttgagtgtggtagttttttatttgttgttgttgtttaatattatatgtgtttagtaagttgtattttttttgtaggtatagattgaggtatggtaattagtaattgaggatttaggttagggtagtgtttttaagtttgttttttattttgtagtatggtggttattgatatttagtttttgtttttgtaagtaagtatagttttaagtataggttattttaattggttttggggttttaggaaagtattgaggttattttgtggtgatagaggtagttgtttaaagaatttggtgtgagtttgaggtaggggttgtggagtgaggtaggtaaaaatgtagattttatagttatattttgatatattgaattagagtttgtgagggtgggatttggaattttttttaaaaagtttagaggaattaatttatatgaataataaaagttttatttgagttaaagattttaatttagaaatgagaaaatggggatttttaaaagggttatagggagagggttggaggaaagttagattatgatagttttagggtggtttttttt

SEQ ID NO: 181 - DNA, 2428 bp, Artificial Sequence
  chemically treated genomic DNA (Homo sapiens)
ggaaagaattattttaaaattgttatagtttaatttttttttaattttttttttgtaatttttttggggatttttgtttttttatttttagattaaggtttttggtttagatgaaatttttattgtttgtgtgaattggtttttttgagttttttaaaaaggattttagattttatttttatagattttgatttagtatgttggggtgtggttatggaatttgtatttttatttgttttattttataatttttgttttaaatttgtattaagttttttgaatagttgtttttgttattgtaggatgattttaatgtttttttaaagttttagaattaattaaggtaatttgtgtttgaagttgtgtttgtttatagaaatagagattggatgttagtaattattgtgttataagatgggaaatgaatttagaagtgttattttaatttgaatttttaattgttaattattatattttaatttgtgtttatgggagaaatgtagtttgttaggtatatgtagtgttgggtggtaatagtaaataggagattgttatatttagttggttttggaaagttttatttttttttaggaatttttgttttttaattatgtgttttaaaagattttaaggagtatttttatattatattttaggtattttgagtaggagtttttttattttattttttgattagtgaatagtttttgttttgtttaattgaatttggtttttttttatgggtgagaaaggtattgggtagggaaaggatttattagggttaaatgatttttttgagatttaggaatatttagatgatttttaagtatttttttaggagtataatttttggtttttgaagttgagatgggaagggaattataatgggtggttgtttagttttttatttaaaatttttttgattttgggttgaggtttttttgtttattgtttttgttagttatttttttaagaattttaggtttgatttgggaaaagaaaaattatttatagaattggagagtttgtttatatggtgtatgtgtttgttagtgtttattgttttggatttataggtgttggaaagtttgtttttttatattttttagttgaattttttttgtttagaagggtttgtttgtgtgtggtaggagtttgggaattgatatttttattggttaatggatgaagagtttttggaggttgttttttttttattggatgtaaatgatttattttttatttattttggaagttaattattattattttagatagtgaagggaagggaaggatgagagtatatgtttgtgtgtgtgtgggtgggtttgaaggttgggtggagggtattgtgtgtttatttgtatttttttttatttgtttggatgattttttttggttttagtgattttttttttgtgttatttagtttatggggatagtttttgtgttttaggataaattaagtaattattgttttgtttttttttttttatgggagttttttgttttttagtggaagttagggaggagttgtgtggtagttgggtggagtgtgaggtatgtggtgtttttgtgtttttttagatttttgattgttagtttgggtagtgtgttggtgggagttgtagggtgaatagttagttaagttgtttaggtgtgtggtagttgttgttattttgtagttgtggggtgggtgatggtggtgggatgagtatttaggtgggattttttggtagtagtagagagagttttatttggatgatgtagaggtttaggttttagtggattttaagttttagagtaggttgtatttgtgtttgtgtgaagtttttagggatttggtttgatttgtaaatgagttaattttgtggaggggttggtgaatatagataatgttagtttggatgaggaagtggttaaaattgtttaggtttggtttttaggatgtgtattattgagtgtggtattttattttttggatgaagattttagagtttggtttttttaaattgatattaaagaagtgttttttatgggatttgagaaaatgttttattgtttaaggaaagaatgttttattgtttgagattttgaatagaaggagatgtttttagtattgggtgttattttttagaagttggttaaagaaggatataagatggttgattaagtggggatggtgataattattttgtaatttatagaaggatagatgtttatgtaatagttgatagttttggtggaataattatgagtatgtttttgaaattaatataaaatatatagagatttttaaaattattgtttaaattatataggttttgtggtgtttggaaagagtaaattttggaagtataattgtaaaaataatgttatatagttaaggagaagagaaaatttaaggatagtttttttaaattgttgt

SEQ ID NO: 182 - DNA, 2485 bp, Artificial Sequence
  chemically treated genomic DNA (Homo sapiens)
tttttgttgttttttttttttaatttagaatttattaaagatagttaaatatgttatttattttaaattaattatttaagagatattatttttgttagtttatttttagtttttttatgttaatatttttaagttagagtatatatgaaattttttttttttgtttattattaagtttttttggttaggtgtagttgtttatttttgtaattttagtattttgggaggttgagataggaagattgtttgagtttaggagtttaagattagtttggataatatagtgagattttatttttataaagaattaaaaaaaaataagttgggtatggtggtatgtgtttgtagagttagttatttaggaggttgaggtgggaggattgtttgtttaggaggttgaggttgtagtgaattatgattgtattattgtattttagtttggatgataatagagtgagattttgtaggtaattaagtaagtaagtagtttttttaatgttttgataggttttgagttggttaaatgtaagtgatggtgattgatttttttgttatagtaagttttgaataaataaagtatttgggtggtttttttttttgattttttttatttatttatttgtttattaattatatattagttgtgttttatttgttaggtagtggttagtattgggaatatgtggaagtaaatagtttttgtttttaaggatattttgtttagtgggatagatagatagatatatatgtataatagtaatttaatgtgttaagtgaaataataggtatgtataaaaaaggtgtagtaggttaagtagggtttttaggggaaggtgatttttaagatgggtggtaagggatgagtaggaggtgatttggttaagaggttgggatggttatttaaggtaggtggaggggtagaatgagtaaaataggatgtgttgttggagtgtggtaaggaaggtaagtagtggtagaggatggtggtagggtggattgtggggtgtaatggatgtgttatgttggaaagagtttggattttatgttgtttttttggaaatgagataatggttggtgtaagtaagaaagaaatatatatatatttatgtgtgtgtgttgttttttttgtgttattgtaaggttaaggagggtggtgatatagaaatttatgatgattggtataagtagatatttaatgaatgaatgaatggatataagtattttggtgtaaatgttattgtttttgatttttgtttttttatggggtaagatagtgaggttggggtattagtttgggaggtgatagggaaggtttaaggtgagagaattgttattttggtagggagggttagtgggtataaaattaataataggttatgggtaagggatgtgttttggttgtgaatattttgaatttatttattggagttattttgttttaggagtggttgtggagaaagtaattagttgagagtttgtgttttagggagggaagtgggtatagggttgtttagtgttatttatttgtgagttttttgtgggttttgtaggtggagttttggtatgatgtttttttgattgggtgtggtttaaagttttggggtgggtattagaggttgagtgttttaggggattggttattttggtggatggatgtgttgttgattgagttggtttgtttttggtttggtttgtggagagttggtttttttgtgagttttttgttagttattggttttttgtggtttttttggggatgtggtgttgttgttggttgggttttttttttggttgggtaaggggttgtggggagtagtttgggattgaattgagaggtgttgaaggaattggtgggttgtttgattttgtgagtgtgggtgtgagagggttgtgggatttggagggatggggagaggaagtgggatttatattttgttatttggggatgattggtttttagaggatagagttggtttatgagaatgttttgtttttaggatgtttgggtagggttttttgggtttgaggaattagagtagatggagtgggagtttggggaggaggtgggagttgtggaatttttgtgtaggtttgttttgtgggtttagttggatagaagtttgaaattaaatttttttaggttgtagatgtaggagatgtttgggataaggaggttatttttttagggtaaaagaaaaagaaggtgataggtgttgagattattgaagggaatttatggttaggtaaggttgtatattttttttttggttgggagtatggtagaggatggtaggtaggttggggggttttgggaggttgttttaagtgaggtttgttttggagttgtatttggattttgtattttggttagttggatgtagagatgattaaagttgtattattttgagggttgataaataatagtttttagtttatagattaggagtggtagagtgagttggtttgtttagttttgtaaagtgta

SEQ ID NO: 183 - DNA, 2485 bp, Artificial Sequence
  chemically treated genomic DNA (Homo sapiens)
tgtattttatagagttgagtaagttgatttattttattatttttggtttatgggttagaaattattatttattagtttttgaaataatataattttgattgtttttgtatttaattaattagaatataaagtttaagtgtagttttagggtaaattttatttgggatagttttttagggttttttaatttgtttgttattttttgttgtgtttttagttggagggaaagtgtgtagttttatttagttatgggttttttttggtggttttaatgtttgttatttttttttttttttgttttgagaaggtggtttttttgttttaggtattttttatgtttgtagtttagaaagatttgattttaggtttttgtttgattgagtttatgagataaatttgtatgggaattttatggtttttattttttttttaggtttttgttttgtttgttttggttttttaggtttaggggattttatttgggtattttgggagtggggtgtttttgtgggttagttttgttttttaggaattggttgtttttaggtggtggggtgtgggttttgttttttttttttgtttttttgggttttatagtttttttgtgtttatatttatgggattaagtggtttgttggtttttttggtattttttggtttagttttgagttgttttttgtggttttttgtttagttggaaggagggtttggttggtggtggtgttatgtttttaaggaaattgtagggagttaatgattgatagaagatttatggaggggttggttttttatgagttgaattgggggtgaattagtttggttagtagtatgtttgtttgttagggtggttaattttttagagtgtttggtttttgatgtttgttttgggattttgagttgtgtttaattggaaaggtgttgtattgaggttttgtttgtagggtttgtggagagtttataggtgagtggtgttgggtggttttgtgtttgtttttttttttggggtgtgaatttttggttggttgttttttttatggttgtttttgggatagagtagttttggtaggtgggtttagggtgtttgtgattgaagtgtattttttgtttataatttattgttggttttgtgtttattgattttttttattagaatggtagtttttttattttaaattttttttattattttttaaattgatgttttgattttattgttttgttttgtgagaaaatagaaattgaagataatgatgtttatattaaagtgtttatgtttatttatttatttattgaatgtttgtttatgttagttattatgaatttttgtgttgttgttttttttgattttatagtaatataaaggaaatgatgtgtgtgtgtgggtgtgtgtgtgttttttttttgtttatattagttgttattttatttttaggaggatggtataaagtttaagttttttttaatgtggtatatttattgtgttttatgatttgttttattgttgttttttgttgttatttgttttttttattatgttttagtaatgtgttttgttttgtttattttgtttttttatttgttttgaataattgttttagttttttagttaaattattttttatttattttttattatttattttaagggttgtttttttttaaaagttttatttgatttattatattttttttatatatgtttattgttttatttagtatgttgaattattattatatgtatatgtttgtttgtttgttttattagatagaatatttttgaaggtagggattatttgtttttatatatttttaatattggttattgtttggtagataaaatataattaatgtataattaataagtaaatgaatgaatgggggggattggggaggaagattatttaaatgttttatttatttaaagtttattatgataagggagttagttattattatttgtatttggttgatttaaagtttgttaggatattaggaaaattatttatttatttaattatttatagggttttattttgttgttatttaggttggagtgtagtggtgtgattgtggtttattgtagttttgattttttgagtaagtgatttttttattttaattttttgagtagttggttttataggtatgtgttattatgtttagtttatttttttttaattttttgtagagatggagttttattatgttgtttaggttggttttgaatttttgggtttaagtagtttttttgttttagttttttaaagtgttgggattatagggatgagtagttgtatttggttaggaaagtttagtagtgaataaaaagggaaggttttatgtatattttgatttgagggtattagtatgggaaagttggaggtgggttaataaaagtagtgttttttaggtgattggtttggggtaggtagtatatttggttgtttttagtgggttttgagttgaagaaaggaggtggtaaaaa

SEQ ID NO: 184 - DNA, 2528 bp, Artificial Sequence
  chemically treated genomic DNA (Homo sapiens)
ggtttgatttttggtttttttttgttagtgtaattattattatggtgtgatttatttttttttttttaagaatgttgaatggtattattttagaggtaggtgagttatgtgttaggttttttttgatgttttttgttttttgggttagtgtgtatattatgtgagtgtgtgtgtgtgtgtgtgtgtttttgttgggtggaatgaagaggagtgtgtgtttgttttaaaaattaaattgtgttttgtaggtttaaaaatatatatttttttttagagttttttgataggatttttgaaattttttttttgtttttttttttgattgtttttgattttttttaggattagtgtttggggtgttaggtagaggttttggttttattgattttttagtagttagtggttttagggatgtgtttttgattttttggggagttgttgggggtgttttttttttggaagggatggaaggggggttgagaagatattgttttttatatgtgtaggggttaattggaaattggttttatttatatttttttgttgttgtttagttttaatttagtgtagttgtttttgtgtttgattttagtggatgtagtgtgggatttttttttttatttttgtagagttgagggtaggtggtgtaataaattttaggtaaaagagtattagattttagaagagttgtattttagatttggtgtaggtttttttggggagaagagtttaggggttatagagaatagaggtttgaaggaagtaaaagttggtgagaggttttttttttgttgtgaagggtgagggtaggtagagaatgtgtgaaagggtagggttttggttgggaagtattgtttagtgaaaggttggtaagggtgtgtagttggagtgtggttttgggtatttttttttaggtagttgaattttttgtattttagttttgtttggttgatttttatttgttttgagggaggattttttagtaggattgaattagaagtgtgtttgtgtagtagttttagtatggatttgttaattttagtgtagggggaaattttttatatggagtattttagtttttattgtttggagaaaggttttagtgtgttttggtaatttgtttattttttatttagtgtagtttgggtatttagggttaggtggtgtggtattgaatgtatggtttttagttttaggttgatgttgatgttttattgggttttgggtgtttaggatagtgttagatgttggatattgttttaagagttgtgttttttaaattgaaggggttttttaattagtttaatagggtttggaggaaaggtaatgttttttttttaaagggtaaatttagaggtgtagaattatggtttttaaaatttaggtagagagagattttaagttatttttgtttttaaaatatgtatatttgttgggttatttttttttttttaattttaattgttttgtgggtttaatttttttttttttttttttagggaattttattgggtttgggttttttgtttatgtagatttatttgagttggtgataagggtgttgtagtttttttgatttttatagagattttaagattttgaatttttagttttaattattatgttttattatagtttggttgtttatttttttaaaagtggtaatagtagtgggatgggtgttgttagaatagaaaggaaagaaagtttagtggattgtgtgtgtttaattgtgagggagagtagtgttggttaagggatttgttttattatatttggtagaattttgaatttagaggagatttaagattttatttttgatgtaggttagagagaattatatgtatttgttttttagtttaggaattgaaaaaatgaatattgtaatttttatggaatatttgtgggttatttagattatagttgggagaagggggaatatttttttttttgtttttagttattgggttttagtttttttgttggagaggtgaaagaaagtagaggtataaagatgttttttttatttaaagtgtttatttaaagttttttgagaatgaggagtggggagtttttaggtaattttttttgggggttttaagataaaaagagtagaaaatttagggttatatatttaatttgagggtatttttttttattttttttgggttttttttttaggaattgtgagagaaggtagggttggatttatggggatgtatttttgtagagttaataaggattttttaaattttagttgatttttattttatttttagttttttttagattttttgtgtttattgagaaggaagaattttggtagtttgtttttttataggaagtagtaaatgttattggatgtaggaatttataatttgagttttataagagtaggaatagttaggatttaatttggaaattgattgtagaaggtgttttgttttgtttgtatttagatgattaataaatttgtgtggaatagaagaatgaatggatgattggagggtttataaaatttttgtgtt

SEQ ID NO: 185 - DNA, 2528 bp, Artificial Sequence
  chemically treated genomic DNA (Homo sapiens)
aatatagaggttttgtaagttttttaattatttatttatttttttattttatataagtttgttaattatttaggtataggtaaggtagaatattttttgtaattagtttttaagttgaattttagttatttttgtttttataaaatttaggttataagtttttgtatttagtggtatttgttattttttgtaaagaagtaaattgttaggattttttttttttagtgaatgtaggaagtttggagaaagttgggggtggggtgggggttagttggagtttgggaggtttttgttagttttgtggaaatatgtttttatgggtttagttttgtttttttttatagtttttaaggaggaagtttaggaagggtgggaaggaatgtttttgaattgggtgtgtgattttgggttttttattttttttgttttggagtttttaagaaagattgtttaagagttttttgttttttatttttaaaggattttaaataagtattttaaataaggaaagtatttttgtatttttgtttttttttatttttttagtagaggggttgaggtttggtggttggggataaaaaaaaaaatgttttttttttttttagttgtagtttgaatggtttgtaagtgttttataaaaattatagtgtttatttttttagtttttgagttgagggataggtgtatgtggttttttttagtttgtgttggggataagattttaagttttttttaaatttaaagttttattaggtataatggggtaggttttttgattagtattgtttttttttataattgagtatatgtagtttattaagtttttttttttttttattttgatagtatttattttgttattgttgttgtttttaggaaagtggatggttggattatagtggagtataatagttggaattgagagtttgggattttagaatttttatgaaggttaaaaagattgtagtgtttttgttgttggtttaggtgggtttatatgggtaaagaatttgagtttagtagaattttttaggggggaggaaagggaaattaaatttatagaatagttagggttgagagggaagaagtaatttaataaatgtgtatattttgagagtaaaggtgatttaaggtttttttttatttgaattttggaggttatgattttgtgtttttaagtttgttttttaagaaggaggtgttattttttttttagattttgttaagttggttaaggagtttttttggtttgaaaggtgtggtttttaaaatagtatttagtgtttggtattgttttgagtatttaaggtttagtgaaatgttagtgttagtttgaggttgggaattatgtgtttagtgttgtgttatttggttttggatgtttgggttgtgttggatggaaggtgagtggattgttgggatatgttggggtttttttttagatagtggagattgagatattttatgtggaaaatttttttttatattgaggttggtagatttatattggggttgttgtatgggtgtatttttgatttagttttattaggggatttttttttaagataaatgggagttagttaagtagagttgggatatggggagtttggttgtttggaaaggggtatttgaggttatgttttagttgtgtatttttgttagttttttgttgggtggtattttttggttaaggttttgtttttttgtgtgttttttgtttatttttattttttgtgataaaaaaaaaattttttgttagtttttgttttttttaaatttttgttttttatagtttttgggtttttttttttaaaggggtttgtgttaagtttagaatatagtttttttgaaatttgatgtttttttatttgagatttgttgtgttgtttgtttttagttttgtagaaataaagggagaagttttgtattgtgtttgttgagattaggtgtagaaatggttgtgttgggttaggattgaataataataaaaaaatgtgggtgaagttagtttttagttaatttttatatgtgtgagaaatagtgtttttttggttttttttttattttttttaagaaagagatatttttagtagttttttggagggttaggagtgtgtttttggagttattgattattggaggattagtggaattaggatttttgtttggtgttttggatattgattttgaggaaagttaaagatagttaaagagaaaggtaaaaggagggttttaggagttttattaggagattttgaaagagaatgtgtatttttgagtttatgaagtgtggtttaatttttaagataaatatatatttttttttgttttatttaatgaaggtgtatatatatgtatatatatttatatggtatatgtattggtttaaggggtagagaatattagaaggaatttggtatataatttatttgtttttagagtggtattgtttagtatttttagaggaaaaggagtggattatgttgtaatggtggttgtattggtagagaaaagttgggagttagatt

SEQ ID NO: 186 - DNA, 2321 bp, Artificial Sequence
  chemically treated genomic DNA (Homo sapiens)
ttagttaattattggaaaggatttagtgagtttggtttattttagttttaatttgggtttgtatataagtaaaaagtaaatgttgaatttttaggtagatttttatgtagatatgtaaaattaattgttttggtggtgaggagttatggggagttttttgaagggttttttaggtagtgggttaatgggtaaaatgattatttagtggttttgttgattgatggtatggatgtgttaaggatatttattagtttatttgagaatatgaaataaagtgttgagattttattatttaaagtaataaagaaattgtaagtaatatgattgatagttagaagggaatattggagttgtggtgtgtaatgttgttttggattagtatttttaaattttgttaagttaaaggttttgtttatttgtgagttttttatatgtatagaattaggtgtggttatgtaaagtttttggatatggtttttatgaagttgggagttgatattaggatgttgatggtgtagatgatggtgaagattgagaaggttatgaggtataggtggtttattatataggtggtgaatttttatttgttgtagattgttttgtttttgttttggtagtggaagtggttggtaatgtagtggattttttttaggattttggttaagtttgggttttttttggggggttgtttgttgtgtaggaggtgtttattgtgtgtgggggagtaggttatgtggttatatattattttagagttgggggttgggatatagtgtatgttgtttaggttgtggaagttgatgtatagtaggtttttgttgttggtgggtggtggtgttatggtatttatttttatattggttaggttgtagtgttgttgtttgtgttggtaggttgggtgtattttgttttttttgggtttttttatttgtaggaattatgtgtattagtttagaaggatgattttggtttggggagataatagaatgttaagagtagttttgaggtggatatgggttgattttaatagtagtaagattttataatataagttttgttttattggttttgggggtagtagtttttattgttttttggatgattttagtaggtaagtagtgtttgtgtatgataagtagttgagtttaatgtgaggtaagattaaaattgatgtattttgggaataagttaaattgttttttggggtaggtatattgtaattttagggaagatagttttgtggaaggggaaggttatttgagttgtgtaaagagggaaagttaatttttttttttgatttttttttatttgtaatttggggatttttagatttaattttggtttttatattatttgttaggtgttttggaaggttattgtaaatttgtaaagagtgtttgggggaggttgtatatttttaaatgtaattttaggatatttatgagatattaggtaaatttgaagtttgaagtagtttaggtttttaatattagattattatattttttgtgatgatgtgattattttgtaaagttgttttttaaagtattttgataaaaagtaaatattaaggaattttatgtgaaatagaaattaggttagtggtttttaatttgattttaagatttgagaggtggtgttgtgttttataggtgttatattgttaaggtataaatatttattaaagtgttttgatttatttaaaaagagagttttgggtattattttttttggttaggggttttgtgaaaaattttttgagatattaatgtgttgtgaattaaggtagttttggaatttttaatttaatttagtaggttttaatgaagattgaataagatgatgtttgggagagtattttgaaaagttgaaggtagaagttggtaaattttttgtaaagggttaggtaattatttatttttgttgatgtagtatatattgaaggtgttaaatggatgggtatgttttttaaaataatttatttataaaaatatttggtggattggatttggttatttaggttataatttgttaatttttggtttaaagtgtgttttagagtgtatgaaagaagttggagaaaaattattatggagtttattttggttttgttttttatggaaagaagagagataattgaagttttaatttaggtaaagaagtatttttgtaagtttatttatgtaaagtgtatgaaaagtgggttttttttttgaaattatttagattttgattttatttatattttgttttatgattttggggaaattttattagtaatttaataggtttattttttatttttaggaaataaatatata

SEQ ID NO: 187 - DNA, 2321 bp, Artificial Sequence
  chemically treated genomic DNA (Homo sapiens)
tgtatatttattttttaaagataggaaataaatttgttaggttattgatggaatttttttaaaattataaaataaaatgtaaatgaaattaggatttggataattttagggaaaaggtttattttttatatattttatatggatgggtttgtaagaatgtttttttatttggattgaggttttagttgttttttttttttttatgagaggtaaaattaggataaattttatggtgatttttttttagttttttttatgtattttaggatatattttagattagaagttagtaaattatggtttaggtggttaaatttagtttattaagtgtttttgtaaataagttattttagaaaatatgtttatttatttgatgtttttaatgtgtgttatattagtagaagtgagtagttgtttggttttttatagaaagtttgttaatttttgtttttaattttttaaagtatttttttagatattattttatttggtttttattgaagtttattgagttaggttagaggttttgaaattgttttggtttatagtatgttagtattttaggaaattttttatagagtttttggttaaaagaaataatatttaaggttttttttttaaatagattaaaatattttaataagtatttgtgttttaataatgtagtatttatggggtatggtattgttttttaaattttgggattagattggagattattaatttagtttttgttttatatgaagttttttggtgtttgttttttattagggtattttgaaaaatagttttgtaaagtggttatgttattataagagatgtggtaatttgatgttggaagtttgaattgttttaagttttaagtttatttggtgttttatggatattttgggattgtatttgaaaatgtataattttttttagatattttttgtgaatttgtagtggttttttagggtatttaataggtagtgtgggagttagagttagatttgaaggtttttgggttatagatgaggaaggattagagagggaaattgattttttttttttatatagtttagatagttttttttttttatgaagttgttttttttgagattgtagtgtgtttgttttggagaataatttagtttgtttttagggtgtattagttttagttttgttttatgttgaatttgattgtttgttatatgtaagtattgtttgtttgttaaaattatttgggaggtagtggaggttgttatttttaggattaatgaagtagggtttgtattgtaggattttattgttgttgggattagtttgtgtttgttttagggttgtttttaatgttttgttgtttttttagattagagttatttttttgaattggtgtgtgtggtttttgtgaatgaagaggtttggggaggataaggtgtgtttggtttgttagtataagtagtggtgttgtagtttggttagtgtggagatgagtgttgtggtgttgttgtttgttagtaatgggaatttgttgtatattggtttttgtggtttggatggtgtgtattgtgttttgatttttgattttggggtagtgtgtggttgtatggtttgtttttttatgtatgatgagtattttttgtatggtgggtaattttttgagggggatttggatttggttaagattttggaggaggtttgttatattgttaattgtttttgttgttaggatgaaagtgaggtggtttgtagtgagtggaagtttgttgtttgtgtggtggattgtttgtgttttatggtttttttggtttttattattatttgtattattggtattttgatgttggtttttaattttgtggaggttgtgtttaaagattttgtgtaattatgtttggttttgtatatgtggaaaatttatagatgggtaaggtttttggtttggtgagatttgggggtgttaatttaggatagtattatatgttataattttagtgtttttttttggttgttagttgtgttgtttatggtttttttgttattttaggtagtagaattttagtattttgttttatatttttagatgggttgatagatatttttggtatatttgtattattggttagtagggttattgagtagttattttgtttattagtttattgtttggaaagttttttggagagttttttatggttttttattattgagatagttggttttgtatgtttgtatgaaggtttatttgaaaatttaatatttgttttttgtttgtgtataaatttagattgaagttaaaataaattagatttattaaattttttttaataattgattgg

SEQ ID NO: 188 - DNA, 2412 bp, Artificial Sequence
  chemically treated genomic DNA (Homo sapiens)
aggtttagtgttttttgtttaaatatattggttgtttggaagtttttgagttttgtttgttggttaggtttaaggaaatgtttggaaatttgagaattagagtattggtttgggttgtggtttttggtagggagagatggttgtttagagtagtgagtggttaggaagtgtattttagttttttattttgtttttgtgtttattgtaggatagagttttggtagaaagtattttagttttaggtgaatttgagttaggataagttttgtgtttttttttagtttagtaggtagatggagggtttgttttttttttagaatggttttttgattttagagatgtgaggataggttgtgtgggtggtgggttttttatgggagtttgggttggagagagtgttgttttttttttttttttttatttaaggttgtttttattaaaattaaatttagttttttgtattattgtgtttttggttgttggaataaaagtagagagttggggaaggtttttgatagattgggtgtgtttgtgagttttatgtagtttgtggttaatggtaggtttttttttttattttaggggagggttatagttttttgtatttttagttgaggttatggttgggttattttggtgattttgggatagatgtggtggggatggtagggtagtgttgatgttttggaattagttttgttgtagttagagttgtttgtggtgtttttagagggtgagtaagaattataggttttttattgtgttattagttggtagttgagtggttatagaagaaagtgtagatgttgtagggttttttttaagtagaggtgtttttaatatatttgtatttgtttgaatttaaagttaaaaatattggtgttggtgttttttttttgttatttgatttatgggtttgttttttttatgttgatgtttgtttttgttgttttttgtaggttgtatgtgggtgttgaaggtgtagaattttttttttttggggaggtggttgtggatttttattttaattggtttaagttttatattggtattaattggtatgagttgtattttagatataatttggttattgaggttttgttgtatgattttagtttttagaggattattagtgtgggtaggtgtttttgggtgtatttagggttgtttgtgtgttggttgtgtggtattagggttgttggggtaggttatgtgttagagaggtttgggaggttgttgtttattatggtagtgttattttttgtagtaatttgtatgggtagtgaggagggatagagggtttgtgttttgtgtgtttttatattggatgtgtttttgatttgttgtatgatgagtggggagatgtttggatagttggtttattgtgttttgtgtttttatttgggtggttttgggggtgttaattggatgatagagttttttttttttggggtagaggaatagaggggtatttttggtggtggtgatttttttattggaagtgtgtgtatggaatttttttgtttttttatatatgattttggttgggtggggagatagttatgagtttgttttttgtggttttgaagttgttttttgttagattttagtaaggtgttgtgtagttttatattgaggagatataggtagggtttaggatggaggtttgggttttttagatggaggagtttgaaggtaatatttttaggtattttgggatttgttgaattggataaaaaagggtatttagttgttgattttaggaaaatatgttattgtagtttttgagtgtggaggtttggtgttattgtttttagtttgtaggtgattgtttgtgaaggttttatttgttattagtgtttggagaggtagtgagggtggggttgaggttttttagtgggagtagttgttttttggggattgtagggagtgggtttgggtgtatatagttgtgggtaggtgtagaggttatgatagtttgaaggtagggttttttttgtgttgtgtgatgaggttagtagttttaggtattagttttatgtgtgttttagaagtaattttggtgttgaaagggttttagtagtttggggttttgtttagttgttgatataggatttaggtgtttttttttaggttagtaggtaggtttttttgagttttttggggttgtttttggttttttttgttgggtgttgagttgtttgttgggtatttatttggttatggggagatagaatttgtagttttttttttattttttgattagtttattttataatagagattagttggataagttgggagtttttttttttttatgttgtttgggagtaatttgaatttttgtttttttttaggtttttttttgtgaaagtgttgttttttttttgtttttgtagtggtttgagggtt

SEQ ID NO: 189 - DNA, 2412 bp, Artificial Sequence
  chemically treated genomic DNA (Homo sapiens)
agtttttagattgttgtaggggtaggagaaaggtagtgtttttatggaggggggtttggaggggggtaggggtttaggttatttttaggtagtatggagggaagaggatttttagtttgtttagttgatttttgttatgaggtgagttgattaaggggtggggagagagttgtaagttttgtttttttatgattaggtgagtgtttagtaaataatttagtatttggtagagagagttagaaatagttttgaagagtttaggagaatttatttgttggtttgaaaggggatatttaagttttgtgttagtaattggatagaattttaggttgttgggatttttttagtattaaggttgtttttgagatatatatgaagttaatgtttgggattgttggttttattatatagtgtaaagaaagttttgtttttaggttgttatggtttttgtatttgtttatagttgtgtgtatttaggtttattttttgtaatttttggggagtagttgtttttattaaagggttttagttttgtttttattatttttttaagtattggtgataaatgggatttttataaataattgtttataagttgagaataatggtattaaatttttatgtttagaagttgtagtggtatatttttttgaaattagtaattggatgtttttttttgtttaatttagtagattttaaagtatttggagatgttgtttttaaatttttttatttgggaggtttaggtttttgttttgagttttgtttatgtttttttagtatgaaattgtatagtgttttgttgaggtttgatgaaggatggttttaaaattataagaagtaggtttatggttgtttttttatttagttagggttgtgtgtagaaaagtaggagagttttatgtatatgtttttggtggaggggttattgttgttagagatatttttttatttttttattttaggagggaaggattttgttatttagttggtatttttgggattatttaggtgaggatgtagagtgtagtggattggttgtttaggtgtttttttgtttattgtgtggtagattaggagtatatttagtgtgagagtatatgagatgtgagttttttgtttttttttgttgtttgtgtagattgttgtaggaggtgatgttgttgtaatgagtaatggttttttagatttttttaatatatagtttgttttagtagttttgatgttatatagttggtatatagatggttttgagtgtatttaaggatatttatttatgttggtgattttttgggagttgaggttgtgtagtagggttttgatggttgggttgtgtttggagtatagtttgtattggttgatattaatgtggaatttgagttagttgggataggagtttatggttgtttttttgggggagaggaattttgtatttttagtatttgtatgtggtttgtagggagtagtgaggatgaatattagtatggaaagaataggtttgtgagttggatgatggggagagggtattgatgttagtgtttttaattttgggtttaagtaagtgtagatgtgttgaaggtgtttttgtttaaagagggttttgtaatgtttgtgtttttttttgtggttgtttggttgttaattaataatatggtgaaaggtttgtaatttttatttattttttggagatattatagatagttttaattatagtaaaattaattttaggatgttagtgttgttttgttatttttgttatgtttgttttagggttattgaaatggtttaattatgattttagttgagggtgtgaggggttgtggtttttttttggagtagaggggagaatttattattgattataggttgtatgaaatttatagatatgtttagtttgttaggaattttttttagttttttgtttttgttttaataattaggggtataatgatgtaagaggttaaatttgattttaatgagagtagttttgggtggggagagaggaaggaggtagtattttttttagtttaggtttttatggaggatttgttgtttatgtagtttgtttttatatttttggggttaagggattgttttggaggagggatagattttttgtttgtttgttgggttggagggaaatgtggaatttgttttagtttgaatttatttaaagttgaggtgttttttgttgaagttttgttttgtggtggatatgggggtggggtggggggttaggatatattttttggttatttgttgttttgggtggttgtttttttttgttgagagttatagtttaggttaatgttttggtttttaaatttttaagtatttttttgaatttgattagtaggtaaggtttagaggtttttaaatagttagtgtgtttagatagaagatattgggttt

SEQ ID NO: 190 - DNA, 2225 bp, Artificial Sequence
  chemically treated genomic DNA (Homo sapiens)
gtatgtatttttatggattaagttgggtttaagttttagttatatgtagattgggaagatgtttgttaggtaagtgttgagggtaggtttattattgattgattgtggtagatttggtaatagtagttgttatttatagtagtggtaattttttgtatttttttttttgaaattaggatatgtttggtgatgtttggagatattttgggttgttataattaaggatggtgtttttaattttagtgggtagtagttagggatgttggtaaatattttagtatgtataggagggttttataataaagaatgatttagtttgtaatattaggaatgttgaggttgaggagttttgttttggagtattgatttatgttatatgttgggttttaagagtttgtttaatttatataattttgtatggtgggtggttatttttattttttagatgaggaaattaaggattagagaggttaagtaattgatttgaagttaaatagtttatgagtggtagagttttatttaaattttgagtatatgtttttagttaaagttttgtatttggtagataggtttaatgataatgtatgatgataattagtttgggtattgtggtggagtgttgtaggtttttaatagtatggagtaggtgaaggggttttgtaagttgtgtaaatgatgatgttgttattggttatattattgggtgagttattgtgtaagaattgtatttaggttatatttttgtgtttttagtagttgtttggtttttggttttagagagttttgattttattttttttgtgaagatttggttagtatttttttgtgagtgttttttattttgttggtatagtggataatgtagaaattagttttgttttttagttgtttgggtttttggaatttggggtgggtgttttgtttttgtattattttttttatgaagtttttgttggtggttttggggaattagtattttttgtttagtagggttagaatgtttggggggtttgtttggaggaagtgtagtattagtataggtgagtgtattttgggaggggtattttattttttaagaagttaaagtttggatattagaattttttgaattttatagatggtgggtgatatattttttaggagaagtaaagtattgttgaagatttttagtttttaaagaaatttttggggtttaggttgtggttgatatttttatttaaggatttattgtggtggttttttagtattagtgaaatttttagtgggtttgatgaaaagtgtatatttgttgatttgtggggttagagtttgattttatagtgtattggggtttgtttaggaggttgtttttaataagtattttgtgattttgttatgggagatgttaatttatatgttttgtgtttgtatgtttatgatgagatgggatatgtaggaggagttttttgaggaagatagttttagggatttagtagttttttgtatattgagtttataagataagaaagtaggtttggatattgtagagaggttgataaaatttgaagtttagtgggtttttattagttggaaaatttaattgattaaagaaaaaagtttattataaaagtaaatttttggttaggtgtggtggtttatgtttgtaattttagtattttgggaggttgaggtgggtggattatttaaggttaggagtttgagattagtttggttaatgtggtgaaattttgtttttattaataatataaaaataagtttgtaattttagttatttaggaggttgaggtaggagaattgttttaaatagggaggtaaaggttgtagtgagttgagagtatgttattgtattttagtttgggtgataagaataaaaatttgttttaaaaaaaaaaaggaaattttttttaaattgaaaaaattttgttttaggttttttgattaattaattataattaaaagaaaatttagagataggttaggtgtggtggtttatatttgtaattttagtattttgggaggttgaggagggtaaattatgaggttaggagattgagattatggtgaaattttgtttttattaaaaatataaaaaaattagttgggtgtggtggtgggtgtttgtagttttagttatttaggaggttgaggtaggagaatggtatgaatttggaaggtggagtttgtagtgagttaagattaggttattgtattttagtttgggtgat

SEQ ID NO: 191 - DNA, 2225 bp, Artificial Sequence
  chemically treated genomic DNA (Homo sapiens)
gttgtttaggttggagtgtagtggtttgattttggtttattgtaagttttgttttttgggtttatgttatttttttgttttagttttttgagtagttgggattataggtgtttgttattatgtttagttaatttttttgtatttttagtggaggtggagttttattgtggttttaattttttgattttatgatttgttttttttggttttttaaagtattgggattataggtgtgagttattgtgtttggtttgtttttgggtttttttttgattatggttaattgattagaaggtttaggataaagtttttttagtttgaaaaaaattttttttttttttttgagatagatttttgtttttgttgtttaggttggagtgtaatggtgtgtttttggtttattgtaatttttgtttttttgtttgaagtgatttttttgttttagttttttgagtggttgggattataggtttatttttgtattattagtagagatggagttttattatgttggttaggttggttttgagtttttgattttaggtgatttgtttgttttggttttttaaagtgttgggattataggtgtgagttattgtgtttggttaaaaatttatttttgtaatgagtttttttttttaattagttgaattttttaattaataggaatttattgggttttaagttttgttagtttttttgtagtgtttaaatttgtttttttgttttgtaaatttagtgtgtagaaggttgttgggtttttgggattattttttttaaggggttttttttatatattttattttattatagatatgtagatgtaaagtatgtgggttggtattttttgtggtaggattatagggtatttgttgagggtagttttttgggtagattttagtgtattgtgaagttagattttggttttgtgggttagtggatgtgtattttttattagatttattgagggttttattaatgttggagaattattgtgatggatttttgggtaaaggtgttagttgtagtttgggttttagaggtttttttagaagttagaaatttttaatagtgttttgttttttttggggagtgtgttgtttattgtttgtgggatttaggggattttgatgtttgggttttggttttttgaagggtggggtgttttttttagggtgtatttatttgtgttgatgttgtgttttttttaggtaggttttttgggtattttggttttgttggatgaggagtgttggttttttaaagttattgataagagttttgtggagaaggtgatgtaggagtagggtatttattttaagttttagaagtttaagtagttgaaggataaagttgatttttgtattatttattatgttggtaaggtgaggagtgtttatggggaggtgttggttagatttttataggagaggtggagttgaggttttttaggattaggagttgggtagttgttggggatgtaggggtgtgatttgagtatggtttttgtataatgatttatttagtaatgtggttggtgatagtattattatttatatagtttatagagtttttttatttgttttatgttgttagaagtttgtggtattttattgtggtgtttaggttggttgttattatgtattattgttgggtttgtttgttaggtgtagagttttggttaaaggtatgtgtttagagtttgaatagagttttgttatttataagttgtttgattttgggttagttatttaatttttttgatttttggtttttttatttggaaaatgagaatgattatttattatataggattatgtggattaaataagtttttgaggtttaatatgtggtatgaattagtgttttggggtagggttttttaattttggtatttttggtattgtgggttgggttattttttgttgtgggatttttttgtgtatgttaggatgtttattagtatttttggttgttatttattagagttaggagtattgtttttagttgtgataatttaaaatgtttttagatattgttaaatatgttttagttttggggggggaggtgtggggaattgttattgttgtgggtgatagttgttgttgttaagtttgttatagttagttagtggtggatttgtttttaatatttatttagtagatatttttttagtttgtatgtgattggggtttagatttaatttagtttatagaggtgtatgt

SEQ ID NO: 192 - DNA, 2205 bp, Artificial Sequence
  chemically treated genomic DNA (Homo sapiens)
atttgtttttatgaaatggtataaaattgggttaaaagttaagggaataggtgtgttaaatttaaaagtttaagtatattgtggagttgaatgaaaaatagttttttgaataattattattaaatgagtaaaagtttaaaaataatgtaaaaagttaaagttggttgggtgtggtggtttatgtttgtaattttagtattttgggaggttgaggtgggtggattatgaggtaaggagattgagattagtttggttaatatggtgaaattttgtttttattaaaaatataaaaattagttaggtgtggtggtgagtgtttggtggtgagtgtttgtaattttagttatttgggaggttgaggtttgaaaattgtttgaatttaggaggtgggagggtgtagtgagtggagattgtattattgtattttagtttggtgatatagtgagattttgttttaaaaaaaaaaaaaagttaaagttgtttgagtaaataaaagattagataaaaattttatgaattaaaaattagttataaagttgtttaattagaataggatgaggaagaaaaggggaaattgattatttttgattaagtgtaaattttaagtaaattattgatattaatagtgagttggagtattttgttttattaggtaattttttgtaaatattttgtaatgattttatatatataaagtttttttatgtttttttttaaaaatatgagatttttttaggttaatgtttaggtgagatgttttttgttgttttagtagtttagttttatttttttttttggttattatgaatgtttttttataattggagagttaggatgaattaattttgagtaagaaatgggaaagtatagtaaagaggtgatagttttgtatttttatatggaaaaagatttagaggagagtagtggtatttttgttttagttttaatttgaatggaggtaggatttttaataatattggatgttttttttttttgttgttttatgtttttttgatgaagaagtaaaaagtggagagtttagttgttttttagggttatggagttttttagttagggatttttttttgttatataattaaggtttagggttttgtttttgtgattagttttttggaaggagatggatgggttttttagagatttttttagggaggtggaagtggggttttgtatttagttgatttgggagaaagaagtgggatgatatgagggaggttgttattaaaggtggtggggtatgggggtgatgagtgagtttggagaggggtgggtggttttgggagttttgtagtaggttttggtatttttggttgtagttggttttttttttttgtttgtttagtttttattggttgtttttttttttattttgtgttttttttttttgtgtttttatttttgattttagtttagtggtaggtagatttgtagggaaggttttggttattgttgttggatggtttttagtttggtatttggttagatatgatgatggtggttttatttgggggtttttgtatagtagtggttttgggtaagtagaattttgttttggggtttataaattttttttttttttttatagtataatattgtggttgtagtaatttttgttatgttttgtgttatttttgttttgtgtagggaggagggagagagagaagagaggaaagataaggtgggaaatgggtgggggagtagttaaggggaggggtaggttgtggagttgttttgttggtggttgtgtgggtgaatggtagttttgttagtttttttaaggattaggttttgtgtattagtattagggttattttttaggagtaaaggttttggttttatgttttaatgtttggagttatttttataatttagattgttttttttgttatattttgtgtgtttttgatgattgagttgagatattttttttgtttttttttagttttgtttattaatttttaatttttaaatatgtttatttgaatgttagtatttttagttttagaattaatatttttggttaattagtatttttgttaaatatatgattgtgatttaaaataataagaaagtaatgatttaatataattttgatggttattgatgttaaagattgttgttgaaagttttaaatggggagtgagtaattttaatttttgaattggttgttttgagttaaggtta

SEQ ID NO: 193 - DNA, 2205 bp, Artificial Sequence
  chemically treated genomic DNA (Homo sapiens)
taattttaatttaaagtaattaatttaagggttggaattatttattttttatttagaatttttagtagtggtttttagtattagtagttgttaagattgtgttgggttgttgtttttttgttgttttaaattatggttatgtgtttggtaagggtgttggttaattgaaaatgttggttttagagttagaagtattggtatttaaataaatatatttgggggttgggggttgatgagtaaggttgggaggagataaaagaagtattttggtttagttgttagagatgtgtaaggtgtaatggagagagtaatttaggttgtgagagtggttttaaatattgagatatggagttaggatttttgtttttgggggatggttttagtattgatgtgtaggatttggtttttgaaggagttgataaaattgttgtttatttgtgtgattattggtaaagtagttttatagtttgtttttttttttggttgtttttttatttattttttgttttgttttttttttttttttttttttttttttttttgtgtgaagtggaagtgatgtgaggtgtagtggaagttattgtagttgtggtgttgtgttgtggggaagggagaaggatttgtaaattttggagtgaggttttgtttatttgaggttgttgttgtgtggagatttttgggtgaagttattgttattatgtttgattaggtattgggttgggagttatttaatggtggtggttagggttttttttgtaggtttgtttgttgttaggttggggttggggatggaggtgtgggggaggggagtgtggaatgggggagggggtggttggtggggattaggtaggtgagggagaggagttgattatggttggaggtgttggggtttgttgtggggtttttggagttgtttgtttttttttgggtttgtttattatttttgtattttattgtttttggtggtggttttttttatgttgttttattttttttttttgggttgattaggtgtagagttttgtttttatttttttgggagggtttttggagaatttgtttgtttttttttagaggattaattgtagaagtagggttttaggttttagttatgtaatgggagagaatttttgattgggaggttttgtggttttgagaagtggttggattttttattttttgtttttttgttgggagggtgtggggtggtgagggagggagatgtttgatgttgttgggaattttgtttttgtttggattggagttagggtaaggatgttgttgtttttttttgagtttttttttgtgtgggggtgtagagttgttgtttttttattgtatttttttgttttttatttgggattggtttattttagttttttagttgtaagagagtatttataataattaagaaagaaaatagaattaaattgttagagtaataaaaagtattttatttgggtattaatttgaggaagttttatatttttgaggaaaagtataggaaaattttgtgtatgtagagttgttgtagaatatttgtagaaagttgtttggtaaggtaaagtgttttagtttattgttagtattaataatttatttgggatttgtatttaattaggagtgattgattttttttttttttttttattttgttttaattaaataattttatggttagtttttaatttataaagtttttgtttggttttttgtttgtttagatgattttgatttttttttttttttgagatggagttttgttgtgttgttaggttggagtgtagtggtgtgatttttatttattgtatttttttgttttttgggtttaagtaatttttgggttttagttttttgagtagttgggattataggtatttattattaggtatttattattatatttagttaatttttgtatttttagtagagatggggttttattatattggttaggttggttttgatttttttattttgtgatttgtttattttggttttttaaagtgttgggattatgggtgtgagttattgtgtttagttgattttgattttttatattatttttggatttttatttatttaatggtagttatttagaaaattattttttatttaattttatgatgtatttgaatttttaaatttaatatatttatttttttggtttttaatttagttttgtattattttgtgagagtaagt

SEQ ID NO: 194 - DNA, 2355 bp, Artificial Sequence
  chemically treated genomic DNA (Homo sapiens)
tgttagatataatttatttaattaagtagtttttttggttagaagagatgttttgattatttagatgggtattgtttagagtattggttttaagttaggtttagtgttagagttaggtgttgagttttattgggttatttttgtagagttgtggttatatgttttgttaggtgttaggaagttatatatagtggtggtgtagatgggagagggtatagtaggtattgtgattatattgtttttagaggagtttgtgggtgttttggattttattgggatgaggtttgagagttagttggtatgttgtgatatggtttataagtttttttttggtagtagttgtattggtattttttatttggtttttagtgtgtttgagaagagtatggtagatgttgttttatttggttaaagtagtagttttttttatggtttttgggattttgagttttttgagtttttaatttattgggtatagggggtggtggggtttgggttttatgaggagtagaggttttatttataaggtttgtttggtaggttgtatttttttatgtttgatattaatttggttgaggttggttttaattattatgtttagaggattgggtagtttttttagggttttggatgagatttggttatggattttagtttattgaagtatttttatagtttgggttttgtggatggatgttatttagggtagggtttgtagtatggtttagttatggatttgtgttattttatagattttttggtttatttgttttttatgtggtgttatagtttagtgttgaatatttatttagattataggtatggtttatggggagatgtagttggtttttaggaggttagtttggtttagtatagtgttattatagtttgtgaaattagttgtatgtgtgttgtttttaattttatggattagtatggtgggtggtatggtagtggtggtggtggttttgattttgtgtagtattagttttagtatgggtttgggtttagtgttttatagagtttggttttttttagatttggattttttggtaattttatttttttagagggttatttaagttttgggaatttggtttagtatgggtttgtagtaggttaaggaatagtagttagatagttgttgttgtttatagttattgtatgtgtagttgatggtatgatttatttgattattaatattttaattgttgtaatattgtttattattatttagtttgttttagttttgtggtttatggtgtgtggtggtatgtataggttttatgtatttggtggaattatagttgtgttatttattagtttgatatgtgtgtttatgattgttttttgggtattttttggatttatagggttgtattgttattttgtattaagtagattttttattgtttttagtgttttatttgtagaagggtttgtttatttggggaaatttgttgttgttaaggtttttggggttgggggttttttaaggttagagatgttagtaggggttgtatgggaagagtttttttttataattatttttgttgttattaaggaggttgtaggagttttagtttttgttttattagttggttagaagttattagtagatgttgtttttgggggtggtagtggggtttttagttggttagggtttgagaaagaggaagtattataggaggagaggtagtggaagtaataggagtagttgttttagttagagtgggagtgggtggagttggagaagttgtgataattttggttgtaagaggagttagagtgggaatgtgtggagttgtagaggtattgtgaggaggagtagttgttggtgtagtgggagttgtaggagttgtagattattaagtattatgtgttgtagtagtagtaagaggaatgttaggtttaatttgtattgtagtgggaatagttagtgtagtagtgtttgtagttggagtagatttagtagttgtagtagtagttgtagtagtagttagaggagtagaagtagtggtagaaggtttttttttttgtagtttgtgaggtatttggttgagggttttttttagtggttgttgagttggtttagaatggttagtattggtttttttttatatatgtagtttttattgttatggtagggtttgaaggatttgggtagttttgtgagtttgtgttgtattggggtttttttagttttgttttagatatgttattgtaaatggaggagtagtgggaggttagttgtagtggtattaagaagtggtattttatgttatgtttgtgggatgtttgtgagttagagtttgggattgagttttgtgtggttaggaggattgttgatagtag

SEQ ID NO: 195 - DNA, 2355 bp, Artificial Sequence
  chemically treated genomic DNA (Homo sapiens)
ttgttgttggtaatttttttgattatatagggtttagttttagattttagtttataggtattttgtaggtgtggtatggagtgttgttttttgatgttattatggttggttttttattgtttttttgtttgtagtgatatgtttgaggtagagttggggagattttggtgtagtataggtttatgaggttgtttaagttttttaggttttgttatggtaatgaaggttgtatgtgtaagggggggttaatattggttattttgggttaatttagtagttgttaggggaggtttttggttaggtgttttataggttgtaggaaagggagttttttgttgttgtttttgtttttttagttgttgttgtagttgttgttgtagttgttggatttgttttagttgtagatgttgttgtgttagttgtttttgttgtagtgtaaattgagtttggtgttttttttgttgttgttgtagtatatggtgtttgatggtttgtagtttttgtaatttttgttgtattagtagttgtttttttttatggtgtttttgtagttttatatgtttttgttttagttttttttgtagttgaagttgttgtagtttttttaattttatttgtttttgttttagttggagtagttgtttttgttgtttttgttgtttttttttttgtgatgtttttttttttttgaattttggttggttgagggttttattgttatttttaggagtagtatttgttggtggtttttggttagttagtggggtaggagttggggtttttgtagtttttttgatggtagtaggggtggttgtgggaagaggttttttttgtgtagtttttattggtatttttggttttgaagggtttttagttttaggggttttggtagtagtaggtttttttagatagataggtttttttgtaggtggaatattggaagtaatgggaaatttatttggtgtaggatagtggtatagttttgtgggtttaagaggtatttggggggtaattatgggtatatgtgttagattggtgagtggtatggttgtgattttattagatgtgtaaggtttgtatatgttattatgtattatgggttgtaggattgaggtaggttgggtggtgatgggtagtgttgtagtaattggggtattgatagttgagtagattatgttattagttgtatgtatagtggttgtggatggtagtagttgtttgattgttgttttttggtttgttgtaggtttatattgggttaagtttttaggatttgggtggttttttggaaaggtggggttattaaggagtttaggtttgaggggaattagattttgtggagtattgagtttgggtttgtgttggggttggtattgtataaggttagggttattattattattgttatgttgtttattatattggtttatggagttgagggtagtgtatatgtgattgattttatgggttgtggtggtattgtattgggttaggttggttttttggaagttaattgtatttttttgtgggttgtatttgtggtttgagtagatgtttgatattgagttatagtgttgtatgggaagtgggtgagttaaaaggtttgtaggatgatgtaggtttgtgattgagttatattgtaagttttgttttaggtagtgtttatttgtaaagtttaggttgtaggagtgttttagtgagttgaggtttatagttgagttttgtttaggattttggaagagttgtttgattttttgggtatggtagttgaggttagttttagttaaattggtgttagatatggaggagtatagtttattaggtaggttttgtgggtagggtttttgttttttatggggtttaggttttattattttttgtgtttggtaggttgggggtttaggaggtttagggttttggggattatagaaggggttgttgttttggttaggtggggtagtatttgttatgttttttttaggtatattgggggttgggtggaaggtgttagtgtagttgttgttaaaggggagtttgtagattatgttatagtatgttagttggtttttaggttttattttggtaaggtttagggtatttgtaggtttttttgggagtagtgtggttatagtgtttgttgtgtttttttttatttgtattattattgtgtgtggttttttggtatttggtagagtatgtgattgtagttttgtaggggtggtttggtggggtttggtatttggttttggtattgggtttggtttgaggttaatgttttgggtggtgtttatttgagtgattaaaatgttttttttggttagaggagttatttggttgggtaggttatatttggta

SEQ ID NO: 196 - DNA, 2380 bp, Artificial Sequence
  chemically treated genomic DNA (Homo sapiens)
gtttttgattatataattgtgttagaagttaatgattaaaagttaatttaaaattattatttgtttggaaatttaaagtgtttttataagatataaatataagaaagaatttaaaatgaaataagattgttttttaatttaatgatgagattataatatggtaataaaatgtttttttttggtttgggaatttttttttgtggtataaggttgtgtgattttaaattatttttaatttatttagatattttaatatttgaaattgagtgatgatgtttttatttatattattttattgtttgtgtgtgtggattttaaattttgaatttaaatgagggggagaaaattaagttgatttttatgattggttttttagggatgtttaaggaatttatgtattttaagaaataaagtttattagttttttttttaaggtgtttgtttataatatttagagggtttggttgtattatgtgtgatgggtggggagttttaagtaggtgggtaggatttaggggtttggtgattaggatagatttttattgtttattattttttttggttttgtttttagttaaattttttataggttttttgtttaattatatagagtgtgtttaaatttttttaggtttttggtagttgaaaattattgttttaaatttttttattatttattatgatataaggttattgtaaataggaaatattttattgatgttataaatagaaagttaatgtttttattataaatagaaaaataattttaagaaataagtaaaataaaaataaaataggggttgggggtggtggtttatgtttgtaattttagtattttgggaggttgaggtgggtggattataaggttaggagttttagattagtttggttaatatggtgaaattttgtgtttaataaaatataaaaattagttgggtgtggtggtgggtgtttgtagttttatttatttgggaggttgaggtaggagaatagtttgaatttgggaggtagagtttgtagtgagttgagattgtattattgtattttagtttaggtgatagagtgagattttgttttaaaaatagtaataattataaataaaaaatagggttaataaaagtatggaatttaattttttttatatgttgtagttatgttttagttttagatttggttgggtatggtggtttatgtttgtaattttagtattttgggaggttgaggtaggtggattatgaggttaggagtttgagattagttttattaatatgttgaaattttgtttttattaaaaatataaaaattagttaggtatggtggtatatgtttgtaattttagttatttaggaggttgaggtaggataattttttgaatttgggaggtggaggttgtagtgagttgagattgtattattgtattttagtttgggtgatagaatggaatgagattttgttttaaaaaaaaaaaaaaaaaaaaaaaaaaaagaagttttagattttggttgtgttggttgtaaaaggagagatttagtaagtgggggttgtgttgtagattgttatttataatggatgggttattgagtaggtttggttaattgggtgtttttttgttggagggttagtatattagattgtaggtggtgtgggttagtaaggtattaggggatgtgttatatatatagtttatttttgtttagttatgtatggatattttgggtttttgagtaaatttgtttttatgtggtgtgattatatggagttatagatatttagtaaggatatgtagtttgtatatttttggtattttagatatagtgatttgtattagggtttgaggtttttttaggggaatttattttttagaattatttagaaataagttattttttatttgtttagtaaaggtttgttgagaggtgtatagtgtttggagtttaagttgtgttaaggtggtaggatttttagtttagtttaggatttttagtagagtttttattttagtgtggaggtttgagaatgtgaggaaggagttgtttagtatggatgagtttaggtagttgttgatgtttagtatttgttgtttggtaggtgtggggtttgggtttttagttatttgtaggatgatagtagtggttagtgggtggtagtttagatttgtttaggatttggatgagaagttatttttttagtagataggatagagtttggtgttatttgatagaatgttttagaatgttggatatatgggatatttgtattgtttgtgatggtagttttttgtgatgtgtgttattgaatatttgatagtagattggtgtagttaaggaatagagtttttaattttattttttttttttttagatggagttttgttttgtta

SEQ ID NO: 197 - DNA, 2380 bp, Artificial Sequence
  chemically treated genomic DNA (Homo sapiens)
tgatagagtgagattttatttaagaaaaaaaaaaatgaaattgaaaattttgttttttagttgtattagtttgttgttaagtgtttagtggtatatgttgtgaggggttgttattatggatggtgtagatgttttatatatttagtattttaggatattttgttagatggtattgggttttgttttgtttgttgaggaggtggttttttatttaggttttgagtaggtttgagttgttgtttgttgattattgttgttgttttgtaggtggttgggagtttgagttttatatttgttgggtagtaggtgttggatattgatagttgtttggatttgtttgtgttggatagttttttttttatgtttttaggtttttatgttgaggtgagggttttattgggggttttgggttgggttgggggttttgttgttttggtgtagtttggattttagatattgtgtattttttagtaggtttttgttggataggtgaagagtgatttgtttttggatgattttaagaggtgggtttttttagagaaattttgagttttggtgtaggttattgtgtttggagtattgggggtgtgtgggttgtgtgtttttgttgggtgtttgtggttttatgtggttatattatgtgggagtaggtttgtttggaagtttagggtgtttgtgtgtgattggatgggggtgggttgtgtgtgtgatatattttttggtattttgttgatttgtgttatttgtagtttggtgtgttggttttttagtgagggaatgtttagttggttggatttgtttagtgatttgtttattgtgggtagtaatttgtggtataatttttatttattgggtttttttttttataattaatataattgaaatttagggttttttttttttttttttttttttttttttttgagatagagttttattttattttgttatttaggttggagtgtaatggtatgattttggtttattgtaatttttgttttttgggtttaagggattgttttgttttagttttttgagtagttggggttataggtgtgtgttattatgtttggttaatttttgtatttttggtagagatggggttttagtatgttggtgaggttggttttgaatttttaattttgtgatttgtttgttttagttttttaaagtgttgggattataggtgtgagttattatgtttagttaaatttagggttggaatatggttgtagtatataaaaagaattgaattttatatttttgttaattttgttttttgtttgtagttgttgttgtttttgagatagagttttgttttgttgtttaggttggagtgtagtggtgtaattttggtttattgtagattttgttttttgggtttaaattgtttttttgttttagttttttaagtaggtgggattataggtgtttattattgtatttggttaatttttgtattttattagatatagggttttattatattggttaggttggtttggaatttttgattttgtgatttgtttattttggttttttaaagtgttgggattataggtgtgagttattatttttagtttttgttttgtttttgttttgtttgttttttagggttgtttttttatttatggtaaaggtattggttttttatttgtagtattaatagaatattttttgtttataataattttatgttatagtaaatggtaaagggatttaaagtagtggtttttagttgttagaggtttgagagagtttgggtatattttgtgtgattgggtagaaggtttgtgggaagtttagttgaggatagggttaggaaaggtgatggatagtgggggtttgttttggttattaggtttttgggttttgtttatttgtttggagttttttatttattatatatgatgtggttaagttttttgggtattgtgggtaaatattttaggagagaagttgatgaattttgttttttgaaatgtatagattttttggatgtttttgagaggttagttatgaaagttagtttggtttttttttttttatttgggtttagaatttaaagtttatatatatgggtagtaagatgatatagataaggatattattatttggttttggatgttaaaatgtttaggtgggttaggggtgatttgagattatataattttgtgttataaagaggaatttttaggttagagggagatattttattgttatgttatgattttattattgagttgaaaggtaattttgttttattttggatttttttttatgtttatgttttataagggtattttgaatttttaagtaaataataattttgaattagtttttaattattgatttttagtatagttatatgattagaaat

SEQ ID NO: 198 - DNA, 2308 bp, Artificial Sequence
  chemically treated genomic DNA (Homo sapiens)
ttaggtaggaggtagttagttggtgatagtgtgtgtgattatagatttttgatttttatagttttagtagttgtttgtaggttttttatgggattgtagtttgggagggtaggaggttttgtatttgtggttggtttgatttgttttttatttttttgtttgttttttttgtgttgggtgttgttgtgatatgttttgtggatatttaggagtttttttagtttttgtgagtgtggatttgggagagagtttttatttaatgttgaggttattggtttatagatttttttgggttattttgtgaagtgtttggttttttttatttttagttttgtagtagtaataaatgggaaggaagtgggtgatgaggataggtagagattttttttatggggttgtttgtattttatttgttgttgtggggtgggtgttgtggttggtgtttagttgtagatttgtaggtgattgtatttttggtggttttagttttaagtaggtagtggttgatttgttttgtttgagggtttagggttgatttaggtgagttttggtggggagggtgggtgttttggtttttttgttttggaattttgtattgtttagagttgttatgttttttggttgtaggttttgtatttgtaaaatgggttgatgaattttaagggttggtttagatttatggattgtagttgtagttgggttagaaggggtggttaggggagttgattttattttttttttttttttatgttaattaggagtttttatttgtttgggattttttgggggtatttatgggtttatagttgtagaattatagtattgggtggggttttagttttggggttaagtttttgtgaggtttgttattatttttttttgttgttttgtttttttgtttgtttgtttgtttggtttttttttttttgagatagagttttgtttttttatttaggttggattgtagtggtgtgattttggtttattgtaagttttgttttttgggtttttgttatttttttgttttagtatttttgagtagttgggattatgggtgttgttattgtgtttggttaattttttgtattttttagtagagatggggttttattgtgttagttaggatggttttgattttttgattttgtgatttatttattttggttttttaaagtgttgggattataggtgtgagttattgtgtttggtttgtttttgttttttttttttttgagatagttttattttggttgtttaggttggagtgtagtggtgtaattttggtttatgtaatttttgttttttgggtataagtgatttttttgttttagtttttttagtagttgtgattataggtatgtattattatgtttggttaattttgtatttttagtagagatggggtttttttatgttggttaggttggtttttaatgtttgattttaggtgatttgtttattttagttttttaaagttttgtgattataggtgtgagttattatgtttggttagttttttgtttttttaaaaatttattatttagttggtgtggtgttttatatttgtaattttggtattttgggaggttgaggtgagtggattatttgaggttaggtgttttagattagtttgggtaatatggtaaaattttgtttttattaaaaagataaaaattagttggaggtgtttttttgaatttaggaggtagaggttgtagtgaattgagattatgttattgtattttaatttaggaggaggaggttgtattgagttaatattatgttattatattttagtttgggtgatagagtaagattttgttttttttaaaaaaaaaatagaaaaaaaaaaaaagaaagaaatttgaagtaattatgattaaatgttaatatttgtttttttatgtggtgggtataggtgtgttttggaagtttttatgttttttgtattttgagattatataaaattatgtttattattttattgtgttatatgatttttgtagaaaagttggtaaattttggaatgtatgaagaaaaagattataatagttagtaatatttttgtttagagagatagtatttattaatttttttttgtttatgtttgtttttggaaaaatgggatattattggtattattttataattttttaatttgtattaatattttttatattttttaaattgaaaaagttggttaagtatggtggtttaggtttgtaaatttagttaatgtgggaggattgtttgagtttgggagtttaggaatagtttgggtattgtggtgagattatattgttataaa

SEQ ID NO: 199 - DNA, 2308 bp, Artificial Sequence
  chemically treated genomic DNA (Homo sapiens)
tttgtagtaatgtggttttgttatgatgtttaggttgtttttgaatttttgggtttaagtgatttttttatattggttgggtttataggtttgagttattatgtttggttagtttttttaatttaaaaaatatagaaagtgttaatataaattaaaaagttataaaatagtgttaatagtattttatttttttgaagataaatataggtagagaaaaattaatggatattgtttttttgggtaggggtattattggttattataatttttttttttgtgtattttagaatttattaatttttttataaagattatgtagtataataagataataaatataattttgtgtgattttaaaatataggaagtatagaagtttttaaaatatgtttgtatttattatgtgaagaaatagatgttaatatttggttataattgttttagatttttttttttttttttttttttgttttttttttgggggggatagagttttgttttgttgtttaggttggaatgtagtggtatgatattggtttagtgtaattttttttttttgggttggagtgtagtggtatgattttagtttattgtaatttttgttttttgggtttaagagagtatttttagttaatttttgtttttttagtagagataaggttttgttatgttgtttaggttggtttggaatatttgattttaagtgatttgtttattttggttttttaaagtgttaggattataggtgtgagatattatattggttaaataataagtttttaaaaaaataggagattggttaggtatggtgatttatgtttgtaattgtagaattttgggaggttgaggtgggtagattatttgagattgggtattggagattagtttggttaatatggagaaattttgtttttattaaaaatataaaattagttgggtgtggtggtgtgtgtttgtaattatagttattagggaggttgaggtaggagaattgtttgtatttgggaggtggaggttgtgtgagttaagattgtgttattgtattttagtttgggtaattagaataaaattgttttaaaaaaaaaaaaaataaaaataggttgggtgtggtggtttatgtttgtaattttagtattttggaaggttaaggtgggtggattatgaggttaggagattgaaattattttggttaatatggtgaaattttgtttttattaaaaaatataaaaaattagttgggtgtggtggtggtgtttgtagttttagttatttgggggtgttgaggtaggagaatggtgagaatttgggaggtagagtttgtagtgagttgagattgtgttattgtagtttggtttgggtgaaagagtgagattttgttttaaaaaaaaaaaaattaaataaataaataaataaaaaaataaaataataggagaagatgatgatagattttataagagtttggttttagggttgaaattttatttagtgttgtggttttgtggttgtgggtttatgggtgtttttaaagggttttaggtagatggaggtttttggttggtgtggaggaaggaaaaggatgaaattggtttttttggttattttttttagtttagttgtagttgtagtttgtgggtttgagttgatttttggggtttattggtttattttatagatgtggagtttatagttgggaggtgtggtggttttgggtggtgtagggttttggggtggggaggttgaggtgtttgttttttttgttggggtttatttgggttagttttgagtttttgagtagggtggattggttgttgtttgtttaaagttggggttgttaggagtgtgattgtttgtggatttgtagttgggtattggttgtaatgtttgttttgtgatggtaggtgagatgtgggtggttttgtgggaggggtttttgtttgtttttgttatttattttttttttgtttgttgttgttgtagggttgggaatgggggggattaagtattttgtagggtgatttggggagatttgtgagttagtggttttagtgttgaatgagagtttttttttgggtttgtgtttgtagggattgaagggatttttgaatgtttgtgggatgtgttgtggtggtgtttagtatggaggaggtaggtagggaggtgaggagtaggttagattggttgtaggtgtagggttttttgtttttttaggttgtggttttgtggagggtttgtagatagttgttgagattatgagggttagaggtttgtggttatgtgtgttattattagttagttgttttttgtttgg

SEQ ID NO: 200 - DNA, 2352 bp, Artificial Sequence
  chemically treated genomic DNA (Homo sapiens)
aggtgatttttggatttattttttttttattattgtttttggatttgaggtttgtagtgttttggtagggttagtaatgatgttgatgttgggagagatgtgattagagggtggagatatgtttgtttattattatttttgtaggttaattttggttagaggtggttatttttggtttttataggttggaggttttatgtatttttgttagttaggttttggggttaggggatatgagagtttttatatttggtagggtgggttgttttttagagagggagtatggagtttgttttatttgttgtggtgggttttagggtttattgagaggtgttggttagtgtaagaggatattttatagttatgtaatttgggttagtgaggatgggtttgtagtttggttagttaaaataagtattgtttggttttagagtgtgaaattgttaggtttaattaaagggagtttagggagttggttgggggttggataggggaagagtttttttgggaagggttgtaggttgtgaggtttgatttattttgtggaggtttggttttgttgttatttgggtattttggggaggatggggggaggtgtttggagttttttttttttttgtttagttagattgggatattttatatataaatatggtgtaagatggagggatagttagagatatttttgttttttttttttgtttagggagttttggaggttggtttttggtgagatatgggttttttgagtagttaggttttggtgggttttgagattttgataggagtttaggtttggttgttattgggaatttatagtgtaggggtaggagttagtgttgattttagggtaggaaggggtattttattatttggtgtagggtttggggtggagtgaatgttttttaaatgttgaggaaaaggaggattatgtgggttgtgttgggttgttttgggggtgtttttaaggttttggggtgatttgatgttgggtatggtttgggggaagggagatatattaatgaggtatgttattttggtgtggtattttgtgtttgtagagggtataatttttttttttgttggttatttttagggttagttaaatgtagtaagaggtattattagttttaagaggaggtgaggggaatatgttttattttgtgtattttaggttggggttttatgagtaggatatggttggtttggagttggttttggatgaggttgattttttatagtagtgaaggggtagtagttgggtaggaagtggagtttggtggagattattaggggagtgaggggttgtgtggttgagtagggggtgtattttttattttatggagtttgggagatggtttttataaagtttatttttagatataggaatgagaaaagtaaaattgaggttggaggaaggtttggaggtattggttgtgtttgtagtggagggaggggtttagtaagaaagtttgggttatgtgggaggtatttttgggttgggagtggtgggagttgtgagttttttatggttttgttgtgtgtgtaaggtgtggggagtgggtgagtttgtgtgttattttggttgggttatttttatttaattttattagatgttgtggtgaagatgtgtttagatgtgggtatatttgatatttgtgggttttgagttatgtaggtgggttttttattgtgtgaggggttttatttaattaagggaaggtttttagaggaaaagattagttttttaaggagggggttttgtttttagatgtaaaattgtagtattaattttttttagatttttagtttgttaaggttgttagtgttttttataattgttggttttttaaattatttttttttgttgttttttatatatatatatagagtttagtatattttttattgattttgtttttttgaagaatttttgttaataggaggatagtgatgggaaatgtttatgatgttttatgtatgtttaatgtaatatgtgttttgtttaaaagattttttgttgttaagtgttttttatggtgtaggggtgttatatgagagtttaggagggttttggggtttgattggatagagttaggtaagggtttgttggtgttgggatggatatttatgttgtttatttaattagggtttttttggagaggaagattttatgtggggaatgttagttttgttttgtagttgaggtttatatttttgttgtgagtattttggatgtgttgtttggtttgttggttttggtaaaattttttttatttgtatataaagttttgagtgttttagtttttgtttttggatatgaaatatagggaaatgatatttagttaggga

SEQ ID NO: 201 - DNA, 2352 bp, Artificial Sequence
  chemically treated genomic DNA (Homo sapiens)
tttttggttgaatgttatttttttgtgttttatatttagggataggggttagagtatttagagttttgtgtgtaaatgggaggaattttgttaaagttagtaagttgggtaatatgtttaaaatgtttatggtaaaaatgtgagttttaattgtagagtggagttggtattttttatatgaggtttttttttttaaggggattttgattggatgggtagtatgagtgtttattttaatattagtgagtttttgtttggttttgtttagttaggttttagggtttttttgggtttttatgtggtatttttgtattataggaagtgtttgatagtaaggggttttttgagtagagtatatgttgtattaaatgtgtgtggaatgttataaatattttttattattgtttttttgttggtaagggttttttagagaaatagaattaataggaagtgtgttagattttgtatgtgtgtgtgagaagtggtgggggggggtagtttaaggaattagtaattgtggggggtgttggtagttttgataggttggagatttaggaagagttgatgttgtggttttgtatttgagggtaggattttttttttggggagttggtttttttttttgaaggtttttttttgattggatgaggttttttatatgatgaggggtttatttgtgtgatttagagtttgtggatgttaggtgtgtttatatttaaatatatttttattataatatttggtgaagttgggtggaggtggtttagttaaggtgatgtgtaaatttatttattttttatgttttatatatgtgataaaattatgggaagtttgtagtttttgttatttttggtttggaaatgttttttgtgtggtttaggtttttttgttgagtttttttttttattgtagatatagttaatgtttttaggtttttttttagttttagttttgttttttttatttttgtgtttggggatgggttttatgggaattattttttgggttttatgagataagagatgtgttttttgtttagttgtatagttttttgtttttttagtggtttttattaggttttattttttgtttagttgttgtttttttattgttgtggagggttagttttgtttgggattggttttaggttagttatgttttgtttgtggggttttagtttggggtgtatgaagtggagtgtgttttttttatttttttttggggttggtggtgttttttgttgtatttggttggttttggagatggttggtaggaaaaggggttgtgttttttatagatatggagtgttatgttagggtaatgtgttttgttggtgtgtttttttttttttgggttatatttaatattgagttattttaaagttttggaggtatttttagggtagtttagtatagtttatatggttttttttttttttaatatttagagggtatttgttttattttaggttttgtattaggtggtgggatgtttttttttattttggagttgatgttggtttttatttttgtattgtgaatttttggtaatagttaagtttgggtttttgttagaattttaggatttattagggtttggttgtttagagagtttatgttttattggggattggtttttaagattttttaggtagaaaaagggagtaagagtgtttttggttgtttttttattttgtattgtgtttgtgtgtgaaatgttttagtttaattgggtgaaagaggagaaggttttggatgtttttttttgttttttttagggtgtttgggtggtagtagggttagatttttatagagtggattaagttttatagtttgtagttttttttaggaaggttttttttttgtttagtttttagttggttttttgagttttttttaattgggtttgataattttatattttggagttggatggtgtttgttttggttggttgggttgtgggtttatttttgttggtttgggttgtataattgtgaggtatttttttatgttggttgatgttttttagtgagttttgaagtttgttatggtgggtggagtaggttttgtgttttttttttgggaggtggtttattttgttaggtgtgggggtttttgtgttttttgattttgaggtttggttggtaaaagtgtatggagtttttagtttatgggagttaggaatggttatttttggttagagttggtttgtgagggtggtgatgggtgggtatgtttttattttttgattatattttttttagtgttagtgttattgttggttttgttagagtattgtgggttttaggtttagagataatggtggggagggggtgaatttaggagttgttt

SEQ ID NO: 202 - DNA, 2229 bp, Artificial Sequence
  chemically treated genomic DNA (Homo sapiens)
gaataggtttatatttattttttgttttttttttttattaatttgggagagggaagagtagagattatggttttaaagtttttgagtatttggttgaagtttagtgttgggtgttatgtgagttggaggaagttagggtgggtggagtttaggttggtttgattgtgaggtttgttagtgtttgttagtggggtgaaggtttagagatgttaggtgttttaagggtttatggtgagaattggttgttagttgttgttgtgttaggaatgattgggtatgggtaggtgtttgtttttttttagtttgttgttgtaaggttatgttttttaggaggaggtgtggttggggttaggtgagtttataggatttttttattaatattttatttatgagattttagagtttagattttatatttattatattatattaggtattgatgagtagtttttttttttgtttttgttgattttggttttttttaaagtttatttgttaaggaggtaagtgttaggggtttagatatgttggaggtagtgtaaagggatgaggatatttatttttaggtgttggatgtggatattttgtttttggagttgtgtttttagggaatggagttttggaggtgtttttgtagttggttgttgtttgggttttatggtttgtatgatttataggttgaggaagttatagttaggtgattttggttttgaaattttttgggatatattggggtgtgtgtatttatttatttttttatttattatagagatagagtttttttatgttgtttaggatggttttgaatttttggtattaagtaatttttttgttttagttttttaaagtgttgaggttataagtatgagttattgtgtttatttagttagtattttatttttattttatttttatttttatttttgtgatggagtttggttttgttgtttagtttggagtgaagtggtgtatttttagtttattgtaatttttgttttttgggtttaagtgatttttttgttttagttttttgagtagttgggattataggtgtatgttattaattttgtttaatttttttattttttgtagagatggggttttgttatgttggttaggttgtttttgaatttttgattttaagggattagttgttttagttttttaaagtgttgggattagtggtgtgagttattgtgtttggttgtgtgtaattttttttttttttttttttttttttgagatggatttttgttttgttgtttaggttggagtgtagtggtataattttagttaattgtaatttttgttttttgggtttaaatgatttttttgttttagttttttgagtagttgggattataggtatttattattatgtttagttaatttttgtatttttagtagagatggggttttattatgttggttaggttggttttaaatttttgattttatgttttgtttgttttgattttttaaagtgttgggattatagttatgagttatggtatttagttagttgtgtagtattttaatgtgataattagtagtagtggggaattatgtagaagtttgttttatggtggggtatgataggtatgagttgggggtatagatgtgtaagtaggaggtttgatttaataggaggtataaaaagtaagaagttagggtaggtaatttgtgggaatatttagtgtttttattatgtgggttttgtttatgtagtggtggtattgtttttttatggtttgtaagtttgtgttttttttttgtaagttatgttgtagttttttgatttgttgggttgttggtggaagaggtggtttattagttttatgttgttgggttttgggatttttttattttttggttattaggttttatttattgttgttgttagtgggtggttttagttttttaatgtatttttgttttttttgtaattttagatttgttttatgaagtttttgtttgtgggttggggatgagtagtagtgggttgatttttgggttggttttttttttgttttagtggtagttatagatttttttgttagttagaaatgtttttatatggttatagagttttttttgtttgttttttatgtttggggttgtgtgttttggttttattggttttatagttgttagagttataattttttgtatttttagtaggtatgttttggaatagtttttgttgtttatttttttttattttatagt

SEQ ID NO: 203 - DNA, 2229 bp, Artificial Sequence
  chemically treated genomic DNA (Homo sapiens)
gttgtgggatgggaagaagtggatagtaggggttgttttggggtatatttgttaagggtgtggagggttgtggttttgatagttgtggagttggtgggattagggtatatagttttaggtatgaggggtaggtagagagggttttgtggttatgtaggggtatttttggttggtggggaggtttgtggttattattgggataaaagagaagttagtttggaggttagtttattgttgtttatttttggtttataggtagaagttttatgaggtagatttggagttgtagaggaagtgggagtatattgaggagttggagttatttattgatagtagtagtaagtaggatttagtgattagagggtggggagattttagagtttagtagtgtggagttgatgggttattttttttgttagtagtttggtggattgaggagttgtagtataatttgtagaagaaggatgtggatttgtgggttatggaggagtgatattgttgttatgtggataaggtttgtatggtgaggatgttgggtgtttttataagttgtttgttttggttttttattttttgtgttttttattgagttaaattttttgtttgtatatttgtgtttttaatttatatttgttatattttattataagatagatttttgtatgattttttattgttattgattgttatattaaaatattgtatagttggttgggtgttgtggtttatggttgtaattttagtattttgggaggttaaggtaggtggaatatgaggttaggagtttgagattagtttggttaatatggtgaaattttatttttattaaaaatataaaaattagttgggtatggtggtgggtgtttgtaattttagttatttaggaggttgaggtaggaaaattatttgaatttgggaggtggaggttgtagttagttgagattgtgttattgtgttttagtttaggtgatagggtaagagtttattttaaaaaaaaaaaaaaaaaaaaaaaaaattatgtatagttaggtgtagtggtttatgttgttaattttagtattttgggaggttgaagtagttgattttttgaggttaggagtttgagagtagtttggttaatatggtgaaattttgtttttatgaaaaatagaaaaattaggtgggattggtaatatgtgtttgtaattttagttatttgggaggttgaggtaggagaattatttgaatttgggaggtaaaagttgtagtgagttgagagtgtgttattttattttaggttgggtaatagagttagattttattataaaaataaaaataaaaataaagtaaaaataaagtattggttggatgggtataatggtttatgtttgtaattttaatattttgggaggttaaggtaggagaattgtttgatgttaggagtttaagattattttgggtaatatagggggattttgtttttataatgaatgaaagaatgaatgaatatatatattttagtatgttttagggggttttaaggttaaagttatttggttatgatttttttaatttgtaggttatgtagattatggaatttaagtagtggttagttgtgggggtatttttagaattttattttttgaggatatagttttgagaatgggatgtttgtatttgatatttggaggtgggtgtttttgtttttttatgttgtttttaatgtatttaggtttttgatatttgtttttttgatagatggattttgagaaaagttgaagttagtgggagtaggaagaaaagttgtttattagtgtttggtataatatggtaagtgtggggtttgggttttaagattttatgggtagaatattggtgggggggttttgtgagtttatttgattttaattatatttttttttgaagggtatggttttgtagtagtgagttggggaggagtgggtgtttgtttatgtttagttatttttggtatagtagtggttggtaattaatttttgttgtggatttttgggatgtttggtatttttgaatttttgttttattgataagtattgatagattttataattaagttagtttgggttttatttattttggttttttttagtttatatggtgtttagtattgggttttagttaggtgtttgagagttttgaggttatgatttttgttttttttttttttagattggtggggagggagggtgggaggtagatataggtttgttt

SEQ ID NO: 204 - DNA, 2280 bp, Artificial Sequence
  chemically treated genomic DNA (Homo sapiens)
ttgttttggttttatgtttgtaaggtttttggtttaagaggtttattgattttttttgtttttttttagttgattataaaataaataaataaataaataaataaataaataaataaataaaaaagtaggatattaaatttgttatttttagagggttttttagtttttttttttatttttgaattgagtgaagtggtgttgatttttattttttgggtatgagtttttgtgtatttgggagatttttgaatatttttggagaagttagaaagttttgggagatggttttgtttgttgttgtattagattgggttttgtaaaggatgtattttttgagttttttttttgtatgtttagtggggtttgttttgattttatttgagggatttattggaggagaggtatggggatgttgtttgagtagtggatttttttggtgtggagtaggttgtttttaggtagagtttgatgggtttttttttttgggtgtttttggttttttggattttagtaggtttgggaaggttttgggtttttttagttgatgtttagagagtttttattttttaagttttgttattgaatttattggttggtgtgtttttgattgtagggtaagggtttgtgtatttttaaagataagtggggtttttggaaggtttttaggtagaaatgagtattatggggaatggtttgtttttaagataattttggggatatggatataataagatagggtggtaagttttaataaggtgggtgtgtggtgtttgagggtggttgggttgggttgggtttggttttgtgtttattttgttaagaattgtttgggtatgggttttgtgggatgttttgtggtttatttttttttttaggatgtaaggaggaatgttttggtgtgtggttagtagtggtgggtattggtttaatggttatggaatttagtattggtagttggttttttttatattgtaggtgtgtagtgtggttgatggagttttttgggttgaggatttagttaggttgttattttggttgtttttatgggaaggggtattaggtaaattgtttaaggttttgagtttaggttttttggtggaggtttttgttggttttgtttagattatggttgttattaggtttttgagttatggttttttgtttgggaatggtttggtgttttggttgtttagttagttttggtgtttttttttggggtttttattgtttgattttgtggtggagtttgttttttttggatttttagagattttggatttgtttgagtatttgttttagttttgtttggttttttaggatagttttaagttatttttttttaggtgagtatagtgaagggtgtgtgggattgttaagttagttttttttgatggtagtattgttttagaaatgtttatttgttttttttttatgtttattttttttgttttttgttgaggaaaaaatgttaatagtgttttgtatatggtggattagtattttggttgttttgggttagttttggtttatttgtgggattttgtttttggtagatgggatttggtgggattttttttattagtttgtttttttgataaattagaaagtggtttttttggattgttttggggatggatttgatttaattgtatttttaatgatgtgttaggatgggaggatggtggaatttgtagggatgagaaggagattgggtatatattaggattttagttttggttttgttttttgggatatattggtatttgggtatttttatgggttatggtaaggttagtttgattaagaggttaaaggtgattggtgttttattgattgttgggggtttggttttaaattttaggtgaatttataattttggaatagtgggattggtatttgggttttttttatgtggtagtattggtaaggggttgggggaagagtttatgttagtttatgttatgtaggaagggagttagtggttattttaaatatattttttttttttatatttggtttatgtttaattttttatggttttgtttagaaggttgtatgtataatatatatagaggtgggtatttttttgatgatttgtgtgtgttgtgggggagtggtagatggtttagttttaagtgttttgatttttttgtttaaatatattttgtgatggaaagtttatgttgattttgtttggtatttaaggtgtgggtagtggtttaatgtttgttgtgggaatatagttgtgttgaatgttatttttaagatagataaaatagt

SEQ ID NO: 205 - DNA, 2280 bp, Artificial Sequence
  chemically treated genomic DNA (Homo sapiens)
attgttttgtttgttttgagaatagtatttaatgtgattgtgtttttgtagtagatgttaggttgttgtttatgttttgagtgttggatgaggttaatataggttttttgttatagaatatgtttgggtaggaagattggaatatttggggttgggttatttattgtttttttatggtatatatgagttgttagggaaatgtttgtttttgtgtgtgttgtatgtgtagttttttgggtagagttgtggagagttggatgtaggttaggtgtgaggaggagaggtgtgtttggggtggttattggttttttttttgtgtgatgtaggttggtgtgggttttttttttagttttttgttggtgttgttatgtgagaagggtttgggtgttggttttgttattttggaattgtgggtttatttgaagtttgaggttaaatttttagtggttagtgggatgttagttgtttttgattttttggttaagttggttttgttgtgatttgtgagaatgtttaagtgttaatgtgttttggggggtagggttggggttgggattttagtgtgtgtttagttttttttttgtttttgtgggttttattatttttttattttaatgtattgttagggatgtggttaggttgggtttatttttagggtggtttaaggggattgttttttggtttgttaggaaggtaggttagtaagaagggttttgttgagttttatttgttaaggatagggttttgtaggtgggttagggttggtttaaagtggttgagatgttgatttgttatgtgtggggtgttgttggtgttttttttttagtaaagggtggagggagtggatgtgggggaagggtaggtgggtatttttggagtaatattgttattaagaggaattggtttggtaattttgtgtattttttgttgtgtttgtttggggaggagtggtttgggattgttttgggggattaggtaggattagggtaggtgtttggatggatttgaggtttttggaggtttgagagaagtaggttttgttgtggggttgggtggtggaagttttagagagaggtgttaggattagttggatagttaggatgttgggttgtttttggataggaagttatggtttgggagtttggtggtggttatgatttgggtgggattagtggaggtttttgttagggagtttgggtttggggttttgggtagtttgtttggtgtttttttttgtgggagtaattggggtgatggtttagttgggtttttggtttgggaggttttgttggttatattgtatgtttgtggtgtgaggagggttgattgttagtgttgagttttgtggttattgggttggtgtttgttgttgttggttgtgtgttggggtgtttttttttgtgttttagggaggaaggtgggttgtggggtattttgtggggtttgtatttagatggtttttgatgaggtggatgtaaggttaggtttggtttggtttggttatttttagatgttgtgtatttgttttgttgagatttgttattttgttttgttgtgtttatgtttttgaggttgttttggaggtgggttgttttttgtggtgtttatttttgtttgggggttttttggggattttgtttgtttttgggggtgtgtaggtttttgttttgtgattagaggtgtattgattgatgagtttggtggtaaagtttgagaaatggagattttttgggtattggttaagggggtttggggtttttttaggtttgttggagtttgggaagttgggggtatttagaaggaaggatttgttggattttgtttggggatagtttgttttgtgttagaagggtttgttgtttaggtagtatttttgtgttttttttttagtgggttttttaggtagaattggggtaggttttattggatgtgtagggaggaggtttggaggatgtattttttgtaggatttggtttggtatagtagtagatggagttattttttggggttttttggtttttttgagggtgtttaggagttttttaagtgtgtaggggtttgtgtttaaagggtggaggttggtattgttttgtttaatttaggagtggagaaggaagttagaggattttttggaggtggtaggtttaatgttttgtttttttatttatttatttatttatttatttatttatttatttattttgtaattaattgaaagaaggtagaaggagttgatgggttttttaggttggaaattttataagtataggattaaggtag

SEQ ID NO: 206 - DNA, 2438 bp, Artificial Sequence
  chemically treated genomic DNA (Homo sapiens)
tgttgtggaggtaaagtgaagtaatgtatataaagtagtgagtagatgtttggtatgtaattttagttaatgtgggttagttttgatagttggggttttgtatgtagggaaggtagggttataggtagaggggtgtgaggattttatttttattttttggtatttatataattttgattttgagtttaatttgtttattgtgagtattagggtatgtaggggagtatagtggaggtggtagtttagggaattttgtaggtgtagggtgagggtttttagagaattttagtatttggtattaggttagattttattagaagaggttgggtgtagtggtttatgtttgtgattttagtattttggaatgttgaggttggtggattatttgaggttaggagtttgagattagtttggttaatatggtgaaattttgtttttatgaaaaatataaaaattagttgggtgtggtggtgtatgtttatagttttagttatttaggaggttgaggtaggagaattgtttgaatttaggaggtagaggttgtagtgagttgagattgtattattgtattttagtttggaggatagagtgaggttttattttaaattaaaataaaataaaaaaattttataggaagaaatggtattattattttattggttttgttagtattttttggaaatggttttaaagggtttttaaggtttagggtggtgtgggttagtgggaggttattttgttttgtaggaataagggagagatggtattagttagttttttattattttttgggaagatatgatgaaaattgattggatggtagatttttttatgaaatttttattaggtggttagggttttggtgggtatatgaatatgtatatagatatatgtatttttgtataaggtttttgaggttatgggttttttggttagtgttggtttgtttgaggtatatatgttggggttagtgggggatgtgggtttggtttttgttttgggggggttttttgtggttagtgtaggtttgagggtgggaatgggtttttttagtttggtgtgtagtttgaagatttgtaatagatagagttgggtttttgtgtgagggttgtttttagtttgatggttttttttaagaggtaggaagggtttttatgggtgtgtagtgtgagtgtgggttggttggttttagggattttttttttttttttttttttgttttttggataatatttattttagaaggttttttttaggtggttttttgttttgtatatgtgtttgtgatttttttagtatggtgatatttttttagtgtgtgagtatgtggtttattggtttatatggatgttttttttttttttttattatgtgggttgttaggtggggttgttttttagttttttaagttttagtttagtgttttttgattgtttgggatttagtatgtgtggatggatggtgggtgtgtatgtgtttttggatggatatttatgttttgtatgtatgtgtgtatatggttatgtttgtattttggttgtgttttatttttagtatttttaggtataaggtgtttttggtaaaggttttgtgtgtatagggttattgtgtgtgtgttggggattattttagatatattttttagttttgtttttgatatgttgtattttggtataagatttgttttgtattttttaattttataatgggtagtagggtttgtttgatttttagattgagttttagtttgtgggggtgatatttgtagttttgttttattggtttttagttttttggtttttaggttaagttttttttttttgtttttttgttttgtttttttttttttttatgtttttttgtttattttttttttttttgtgggtttatatgggtttttagtaagttgttttgagttgagttagggaatgaggttttggatgagtttttaggtagttgggggagagaagttaggtttttagttaggttttttagggtggtttagtttgatagtttgggttatagtataagttagttgttttttttttgtttttaggtggggattttattttttttttgttgaatatgatgaaatttaggtttttttttttttttttttggtgatagagttttgttttgttgtttaggttggagtgtggtggtgagattttagtttattgtaatttttatttattgggtttaagtaatttttttgttttagttttttgagtagttgagattataggtatgtatttattatgtttggttaatttttgtattttttagtagagatggggttttattatgttggttaggttggttttaggtttttaattttatgtgatttatttgttttggttttttaaagtgttgggattataggtgtgaggtattatgtttggtttgatttagattttattaaggttttaggagaatag

SEQ ID NO: 207 - DNA, 2438 bp, Artificial Sequence
  chemically treated genomic DNA (Homo sapiens)
ttgtttttttgaggttttagtaaggtttgggttaggttgggtgtggtgttttatgtttgtaattttggtattttgggaggttgaggtgagtggattgtatgaggttgggagtttgagattagtttggttaatatggtgaaattttgtttttattgaaaaatataaaaattagttgggtgtggtgggtgtgtgtttgtaattttagttatttaggaggttaaggtaggagaattgtttgaatttggtaggtggaggttgtagtgagttgagattttgttattgtattttagtttgggtgatagagtaaggttttgttgttaaaagaaaaaaaaaagaggtttgggttttgttatgtttggtggggaggggatggagtttttatttgagagtagggaggggatagttggtttgtgttgtagtttgggttgttaggttgagttattttgagaggtttggttgaggatttggttttttttttttagttgtttggaggtttatttagggttttattttttggtttggtttaggatagtttgttgagggtttgtgtgaatttataggggaaagaggaatgagtagggaggtatggaggagggaaggagtggggtagagaaatgggggaaggagatttggtttggggattggagagttaggggttggtggggtagagttgtaggtgttatttttataggttggggtttagtttgggggttaggtaggttttgttgtttgttgtggggttggggggtatagggtaggttttgtattagggtatagtgtgttagagatagagttgggaagtgtgtttgagatggtttttagtatatatatagtggttttgtgtatatggaatttttgttagaaatattttgtatttagaggtgttgagaatggggtatggttagaatatggatgtgattatgtgtatatgtgtgtgtagaatgtgggtgtttgtttagggatatgtgtatatttattatttatttatatatgttgagttttgggtagttagggagtattaggttggggtttgggaggttgagaaatggttttatttggtagtttatgtggtggaggaggaggaagagtgtttgtgtgagttggtgagttatgtgtttatatattagaggagtgttattgtgttagagaagttataagtatgtgtgtaaggtaggaggttatttgggaagggttttttggagtgggtgttatttagagagtaggaggagagaagagaggggggtttttgggattggttagtttatatttgtgttgtatgtttgtggaggttttttttgttttttgaaaaaggttattaggttgggagtggtttttatgtgggagtttggttttgtttgttgtaggtttttaagttgtatgttaaattggggaagtttatttttatttttgagtttgtattggttatagagagtttttttggggtagaggttaagtttatgttttttattggttttagtgtgtgtgttttgagtaggttagtgttggttaagagatttgtggttttgaaggttttatgtgagggtatgtgtgtttgtatgtgtgtttgtgtatttattagagttttggttgtttagtgaaagttttgtgagaaaatttattatttagttgatttttgttatgtttttttggggggtggtgaggggttggttggtgttgttttttttttatttttgtagagtaagatggttttttattggtttatattgttttgaattttggagattttttgagattatttttagagagtgttggtagaattaataaaatggtaatgttatttttttttgtagagtttttttgttttgttttggtttgagatggagttttgttttgttttttaggttggagtgtagtggtgtgattttagtttattgtaatttttgttttttgggtttaagtgatttttttgttttagttttttgagtagttgggattataggtatgtattattatgtttggttaatttttgtattttttgtagagatagggttttattatgttggttaggttggttttgaatttttgattttaagtgatttattagttttggtattttaaagtgttgggattataggtgtaagttattgtgtttggttttttttggtagaatttggtttggtgttgggtgttggggttttttggaagtttttattttgtatttatagggttttttgggttgttatttttattgtgtttttttgtatgttttggtgtttatggtgaataaattgggtttagaattagagttatatgggtattaggaaatgaaggtggaatttttatatttttttgtttgtgattttattttttttgtgtgtaaagttttagttgttagagttgatttgtgttaattaggattatatgttaggtgtttgtttattgttttgtgtgtattgttttgttttatttttatgata

SEQ ID NO: 208 - DNA, 2403 bp, Artificial Sequence
  chemically treated genomic DNA (Homo sapiens)
agaaaagttaaatttagtttttgtttttgttttttttggttttatgatgtgtatttgttattttgaaattggaaattagtttattaatgtttgtgttaattttttattttttttttaatttttttttttatatgattttttatttatgtaggatgtgtgttgtttaatgatgggatgattatatttttttatgttttaaaagtgttttttttttatagggttttagggttggtggttgttttgggtttatagttatgttttatttgttttttgttttaatagtttgtgtggtggtaaagttggtgtggggttggggaatgtagtgttttttaggaggggatttggttttttttttgtagtgtaggtgaaggtttagatgttagtgtgattttttataaggtgtggtttttagattttttggttggaagtgatgtttttttgttgtgggttttgggtttgaagtagtttggtttttttttggtaagtggttggtgttttagtagttgtaatttgagtttagttatttatatattattgtggttgatatttttattaaaaagttttttgagatgatttgtgtgtatgttgattttatgattagtgttgttgggaagaattttagagttggtggggtggggttggaagtagtaggtgtagtgatagggttgggtgtttaggaggttttagtgtttaattaggttaaggtggttaagtttaggttgtagggaaggttggtttggggggtgtgggtgagtataggtaggtattagttgggtagtgttaggatgttggagtagtatttgtaattttattgagtggggtagtttggttggggtagggattgttgttgttttggtagagagagaggatttttattggggagaggttgttttgattttgtaggtgggatagggatagatggttattagggtgatttggttggtttttttttgttatgttaagttttgggatatggaggatttttgttatatagtttgggtttgggtttttatttgtggttattgttttggtatgagttttttagttttgggtggtttttgtttggtttgggatttggtgttgttgttgagtttagtttttttgttatttttgtatgggttgtgggtggtgatgttagttgttttttattttggttttagtagtttatttagtttataggggagttgttttgggttggagatgggtatgtattttgggttttatttgaatgaatgtagtttgaggagatttggttatatatattgggttataggttatttttggtaatgtttatattagttgttagtttgagtttttttaggagagtaaggtttatatgataaaggttgtttgtggttagtgaggtggttgagtttagttaggattttttttggatttttgggatgtggttttgtttgtgagttgtttggttagtttttttggggtgagaggggtttgttatatgggtttttgtttgtagtgtgattttttttagttttttttagtagttttgtttgtagagtgttattattattatgattatttttttgatattgtgagggttgggggatgttttgggtagagatagggtttgtggtagtagtaggtttaggggtgttttatattggtgggttggggatttggtggagattatgttaagggttggataaggggatgagtttttattttggtttttttgtaggttttagtagttttttttataggtagaagggttgatattgggttttgtttttattgtaagagttgtaagtgttatgtgttgttttgtttaatttggtgtttgtaggtgaggaaaggattgttgttggtttgtttttgagtgtttagtatttaagggtgatagtattgtttgtttttattttttgggttttgtttgaagattaaatttatgtttataggataattttttttttttttagagatagggttttattttgttatttaagttggagtgtagtggtgtgattatagtttaatgtagtttttaatttttggatttaagggatttttttgttttagtttgttaagtagtttggattatagttgtgtgttttattattattttgtagatatggggtttggttatgttgtttaggttatttttaaaatttttggttttaagtaatttttttgttttagttttttaaaggttgggattataggtgtgaggtaaggtatttagtttagttatagagttttattgtattttttttattaggagtaagagttgattgtttttttatttttattttagagtgttggggttgtgttgagttgaggttgggttattggtatggtttagggagtgggattatttattgttgttttaaatttgagattattttattttgataagatttttttatttaatttttttatttg

SEQ ID NO: 209 - DNA, 2403 bp, Artificial Sequence
  chemically treated genomic DNA (Homo sapiens)
taagtaaagggattggatgaggaagttttgttaaggtggaatgattttagatttggggtagtagtgaatgattttgttttttgagttatgttagtggtttggttttggtttaatatagttttaatattttggaatggggatgagggggtagttagtttttgtttttagtaagagagatgtaatagggttttgtggttgagttgggtgttttgttttatatttgtaattttaatttttgagaggttgaggtgggaggattgtttgaggttgggaattttgagaatagtttggataatatagttagattttatgtttataaaataataataaaatatatagttatagtttaagttatttggtaggttgaggtaggaaggttttttgagtttgggaattggaggttgtattgagttataattgtattattgtattttagtttgggtgataaagtgagattttgtttttaaaagaaaaaaaaattgttttgtgagtatgggtttgatttttaaataggatttggagggtagggatagatagtgttgttatttttaggtgttgaatatttagaaatgggttagtggtagttttttttttatttgtagatattagattgggtagaatagtatgtggtatttgtagtttttgtagtgagggtagaatttagtgttaatttttttgtttgtgggaggggttgttgaggtttgtggagaggttagggtggaggtttgtttttttgtttagtttttggtgtggtttttattaggtttttagtttattagtgtagggtgtttttgagtttgttgttgttatgggttttgtttttatttaggatgttttttgatttttgtagtgttagggaaatgattatggtggtggtgatattttgtaggtagggttgttgagagaagttgagaagggttatattgtaggtaggggtttgtgtgataagttttttttattttgagagagttgattaggtagtttatgagtagagttatattttgggagtttgagaaaggttttggttgggtttagttattttattggttatgggtagtttttgttgtgtgagttttgtttttttggggaggtttaggttgatggttgatgtgggtattgttgagggtaatttgtggtttagtgtatatggttgggtttttttaagttgtatttatttaagtaggatttagggtgtatgtttatttttagtttagggtagtttttttgtaagttgggtgagttattgaagttaaggtgggaggtagttgatattattatttatggtttatgtggaggtggtagaaaggttggatttagtagtaatattaaattttggattaggtagaaattatttaagattgaggggtttatgttagagtggtggttataggtaagaatttgggtttaggttgtgtggtaggaattttttatgttttagggtttagtatagtaaaggaagattagttgggttattttggtggttatttgtttttgttttatttgtagagttagaatagtttttttttagtggggattttttttttttgttaaagtaatagtggtttttgttttaattagattattttatttagtggagttatggatgttgttttagtattttaatattgtttagttggtgtttgtttgtgtttatttatattttttaggttggttttttttgtagtttgggtttggttattttggtttgattgagtattgaggttttttgggtatttagttttattattgtatttgttgtttttagttttattttattggttttggggttttttttagtggtgttgattatgaagttaatatgtatgtaagttgttttaggaaattttttaatgaaagtgttggttatggtggtgtgtaggtggttgagtttagattgtagttgttaagatattagttatttattaagagaaagttaggttgttttaaatttagggtttgtggtaaaaaagtattatttttggttggggagtttggaagttatgttttgtgggaggttatattggtatttaggtttttgtttgtattgtagaaggagagttgggtttttttttggagaatgttgtgttttttagttttatattggttttgttattatataggttgttgaggtaggaggtgggtaagatgtagttgtagatttaaagtaattattagttttgggattttgtgggagaggagtatttttagaatatggaaaagtgtggttattttattattagatagtatatattttatataaataaaaagttgtatggggaaggaggttggggagggaataaaaaattggtatagatattgatagattggtttttagttttaaggtaatagatgtatattatgagattagaggaggtagagataagggttggatttggttttttt

SEQ ID NO: 210 - DNA, 2311 bp, Artificial Sequence
  chemically treated genomic DNA (Homo sapiens)
tttgtgatattaggaggtatattaagtttttttttgtttttaatatagattagaggggtggtttattatttttttgggtggaggatgtgtggagttagaggtttttgggtggttttttggttggttattagagatttttgggagttagtttgtagggtaggagtataatgatgtggttaggattttagaaaggggttggagtgtttgttttagtttttaggataatggtgtaatggttttagttaggttaggtgttggttgttgttgggaataatttttgagttttgtgattttatagtgtgggtatgagggtttttattttatagatgagaatattgaggtaagtgtagtttttggttaaaattatttagttgattagtaaaatttagtttatgtttgatagattttatagtttgtagtattttagtaggaagtagggtaattgatttaggggttaatttatgttttaggtttttgagaaggagttttggggaaggagggtggggtgagtgttataggttggagggttgtgttagggtaggttttgtaggggtggtgggtatagttttgtttttgggtttggtttttttgttgtgtgtgtaggtgagtattattgtgatggtggtgaaggtggtagtgttgatggggaaggtgtgtagtagtgtggatgttagtttttgtgtgaagatgtgttagtttttggtgtggtagttttggtgtatgtagtttaggatgttgtggtagtgtggggtgttttgtagtttgtttgtttgtagttgtgatttgattatgtttataggataggtagagagttaggatatgatgtttgatgtattgtttgttaatagtagtttgggtattagtaggtggttgtttggtttgtagtttagtgtttgtgtgagagtgttataggtgaggaagtagatgttgaagttgggtgttttatgtagtaatgtggatattatgttttggttgatgttatgtagatttttgtgtttgtagatttgtgtgaggtagtttagtgagtttttgtaggtgtgtgttgggtttgtgttttgtagttgtagttgtgttttggttagttttatggggtagtagatgatgtattggatggtgtttgttgttgtatttgttaggaattggttgaggggtgagttgtggtttagggtttggagggtgttgttttgtattttgaatattagtgtgttgatgaaggtgagttttatgagtggtgagtttaggtttttgtataggtttagtatttgtggggatagagatgttattagagttggtaatgtgtattttttgggttttttatgtggaagggggttgggggatggtagttttagtttattttaggggtttttgaggattaagtagaattttgttagaatttaggttttgattggttttttggttgttttgatatttttttttttggttttttggtttggggtggtggtagtttggaagttagttttttattttgtgttttttgagttttattagtttaggttatttatgtttttttgtttgatgatggatttgaagtagtgtaatgttttgtggtattgaggtttttttatgttttggatttgaagttgtatttggaaggagagggtttagtgagaggtaggtaggtaggattagagtatttagtttttgggtttggtgtttaggttgtttaggagggttttttaaggaggttgggtatttaggtatagtttaagatttttgtaattttagggtagggtgggttgggtatttatgtttttttaggatggggtgttagtaggtaaatagttaaagggataggttgttggagatagggtagggggtttttaagattttagattaatttaggttaagttttttgtttatattatggttgtatagtgtattgttagtggggtatgaatgattttttgagattggtttgttttttaggtgatgtttgttatattgttgagtgagtggtttatgttttagattaggttgaagggtttttgttttaatgttttattagagattggttttgaggtaataggtgtaaaaagtgatgagtttggttaggtgtagtggtttatgtttgtaattttaatattttgggaggttgaggtgggtggattatttgaggttaggagtttaagattagtttggttaatgtggtgaaattgtgtttgtaaaaaaaattagtttagtgtggtggtatatgtttgtaatttttgttatttaggaggttgaggtgggagaattgtttgaatttgtgaggtagaggatgtagtgaggttatgttattgtattttagttt

SEQ ID NO: 211 - DNA, 2311 bp, Artificial Sequence
  chemically treated genomic DNA (Homo sapiens)
aggttggagtgtagtggtatgattttattgtattttttgttttatgggtttaagtaatttttttattttagttttttgagtagtagggattataggtgtatgttattatattaggttaattttttttatagatatgattttgttatgttggttaggttggttttgaatttttgattttaagtgatttatttattttagttttttaaagtgttgggattataggtgtgagttattgtatttggttaggtttattattttttgtgtttattgttttgaagttagtttttgatgggatattagggtaggggttttttagtttagtttgggatatgggttgtttatttagtagtatgataagtattatttggagaatgggttagttttaggaggttgtttatgttttattggtagtgtattgtgtagttatagtgtaaataagaggtttaatttgaattggtttgagattttggggattttttattttgtttttagtagtttgtttttttagttgtttgtttattggtattttattttgagaaggtatagatatttggtttattttgttttggaattataaaagttttagattgtgtttgagtgtttggtttttttgggagatttttttaggtagtttaagtattagatttgggagttgggtgttttggttttgtttgtttgttttttattggattttttttttttaggtatggttttaggtttagagtgtggagaagttttagtattgtgggatgttgtattgttttaagtttattattaagtaagagagtgtgagtggtttgggttggtggggtttgggaggtataggatggggaattagtttttgggttgttattattttagattagagagttaggaaggaaggtgttaggatgattaggaggttagttaggatttaggttttaatgaaattttgtttggtttttaggagtttttggggtgggttggggttgttattttttgatttttttttgtgtggagggtttgggaggtgtgtgttgttggttttgatggtgtttttgtttttgtaggtgttgggtttgtataagggtttgggtttgttgtttatggggtttatttttattaatgtgttggtgtttggggtgtagggtaatattttttgggttttgggttatgatttgttttttaattagtttttggtaggtgtggtggtgggtgttatttagtgtgttatttgttgttttatggagttggttaagatgtggttgtagttgtaggatgtgggtttagtgtgtatttataagggtttgttggattgttttgtgtagatttatgggtatgagggtttgtgtggtgttaattggggtatggtgtttatgttgttgtgtgagatgtttagttttggtgtttatttttttatttatgatgtttttatgtgggtgttgggttgtgagttgggtgattgtttgttggtgtttaagttgttgttggtgggtggtatgttaggtattgtgttttggttttttatttattttgtggatgtggttaagttgtggttgtaggtggatggattgtggggtgttttgtgttattgtggtattttggattgtgtgtattagagttattgtgttgagggttggtgtgtttttatatgggggttggtgtttatgttgttgtgtgttttttttgttaatgttgttatttttgttattgttatggtggtgtttatttatgtgtgtggtgaggaggttgggtttgagggtgaggttgtgtttgttgtttttgtggggtttgttttggtgtagttttttagtttgtgatgtttattttgttttttttttttagggtttttttttagaaatttgggatataaattggtttttgagttgattgttttgttttttgttgggatgttgtgagttgtggagtttattagatgtgggttgaattttgttgattagttgggtagttttggttgagaattgtatttgttttagtgtttttatttatgaaataaggatttttatgtttatattgtagagttatgaagtttagagattatttttagtagtagttagtatttggtttggttgaggttattgtattgttattttggaaattgaggtagatattttagtttttttttgggattttggttatgttattgtgtttttgttttgtaggttggtttttgggggtttttgatggttaattaaggggttatttagggatttttaattttatatattttttatttgggggggtggtgggttatttttttggtttgtgttagggatagaggaaaatttggtgtgttttttggtgttataga

SEQ ID NO: 212 - DNA, 2271 bp, Artificial Sequence
  chemically treated genomic DNA (Homo sapiens)
agattttagaggtattagagttggagatttttgagttagttaatattattttatttttgattttataaaagggaaattgaggtttagagagaggtttgtttgagtttatatagttagttagtggtagggttggggtgaggatttagggatttgttatttgtgaggtgtttttgtatgttatattgtttttttaagaatgtgtatagttttagagtttgaaggtttaaaatatagggtatagggatatttaaagagtgatttgttttttttagtttttgtattggtaggagtttggaaggataatttttgagtttttttttttaaaattagagtttttgaatttgataatttgattttaaggatgttgatagtaggtgttatgtttgatgtataatgaataataaagtatttatttgtgtgttaggtgtggttttgtatgttttgtatgtattaattttttgagttttataataaattttattagatgggtatgataatttatatttttatttttttaaatgagaaaattgaggtttagagaggttaagtaaattgtttaaggttgtagagttgggaagtagggaagttaggatttgtatgtaggagtttgtatttagaggttgtgggttaattattgaatagtattgtttttttgaaggttgggtttttgttatagttttgtttgttttgtttgtgataggaagtagatgtaggtaggtttgagtttgtagtaatttattgtagtatgtggatttaggttaattttgaggaagtttttttagatttatgagaaaattgttaattataggttttgagttattttaggaggaagttgtttgggtttaggggagatgagtgtggttaggagtttgggagtagggtgggtttaggtaggatagtataaggatattgatttttagttattttaggtagaggggtagttttggtttttgggtattgtgatttgtttaagattatattgtgagttattaggaaaggaggaattagtgatagttgtgattttataagttgtttaataagagtttgggttggataagttattttaatgattagtataggttttaagttttttttggtgggtagaaggttgtggtttgattgagttggaagttgagaggatatggtttttgtttttttattggaggtataaaggggagatttttattttttatttttttgagtggtttaggttttttttaggttttaggggaagaattggggttgtgtttgtggttgattttatattttggttaaataattttagtttatgttttttttaagatttttgttttttaaagtatttttatatttgttgttggttttgtatataaataattttttggttgttgttgtgttttattttatagaggtagaaatggagttagttttggagtgaatgttagttatatttgtttggaaagtggattttagtttttttattttttatttttgtggtatttttttagggtatttttagttatttgatagagaaggaaattgaggtttagagtaggatagggatttgtttagggttttttagagaggtggagagtaggagtttttttatttgtggggttttgtagatgatgggttattgtagatatttatatttatataagtatgtatgtatatatatttggggtttgtatatttattatatggtagatggttagggtggtggttgtgatgtggatattgaagtagtagtaggtttggtggatagtggataagtgggggtttatggtgttgttgtttttttttttgagatattgaaggggaaagagtttggtgtttggagtagggtagagaaggggaagttgttggttgttttttttattttttttttgttttttagataggtagggataaggttgttatagttggggtggggtagttggggagggggagtggggatagggtagtagtttgttttagagtattttattgttttttgttatttttaggagggggttttagagaggatagattttaatatggttattatgtttttttttgtattagggttagggttttattgttttatatagtttgtttattagaagaatattattaattttggaagttaggattgttattaagtttatttttagatgaggaaatagttgtttagagaggttaaggtatttgttttaaattatatagtagttagtattggtggtagaatttaaatttagatttgtttggttgtaaaaatagttattgtttaggaggtattttttgtttttttta

SEQ ID NO: 213 - DNA, 2271 bp, Artificial Sequence
  chemically treated genomic DNA (Homo sapiens)
tggaagaggtaggaaatgttttttagataatagttatttttgtagttagatagatttgggtttgaattttgttattagtgttaattattgtgtgatttggggtaagtgttttgatttttttggatagttgtttttttatttggaaatgggtttggtaatagttttggtttttaaagttggtagtgtttttttagtaagtaagttgtgtgaaatggtggaattttggttttggtgtagagaagggtatgatgattgtgttagggtttgttttttttggaatttttttttgggaatggtagagggtagtggggtgttttgaggtaggttgttgttttgtttttattttttttttttagttgttttgttttagttgtgatgattttgtttttgtttgtttaaggggtaggaaggaagtgaggagggtagttagtagtttttttttttttgttttgttttaggtattaggtttttttttttttagtgttttagaggaggggatggtagtattatggatttttgtttgtttattgtttgttagatttgttgttgttttaatgtttgtattgtaattattgttttggttatttattatgtggtgagtgtgtgggttttgggtgtgtgtgtgtgtgtgtttgtgtgagtgtgaatgtttgtggtgatttgttatttatggagttttataaatgaaagaatttttgttttttatttttttgggggattttgggtaaatttttgttttgttttgggttttagtttttttttttgttaaatggttgggggtattttggggagatgttgtaagagtgaggagtaagggagttggaatttattttttaggtaaatgtaattgatgtttattttgaggttggttttgtttttgtttttgtgagatggggtatagtagtagttggaaggttatttgtgtgtaaagttaatagtagatgtgaaagtgttttggaaggtagggattttgggaggaatgtgggttgggattgtttgattgggatgtgaggttggttgtagatatagttttgattttttttttggggtttggagggagtttgggttatttgaggggatgagaagtggggattttttttttgtgtttttagtggggaggtaggggttgtgtttttttagtttttagtttagttaaattatggttttttgtttattaaagagaatttgagatttgtgttaattattagggtaatttgtttggtttaagtttttgttgggtaatttgtgaagttatggttgttattggtttttttttttttggtgatttatagtgtggttttgggtaagttatagtgtttgggggttaaggttgtttttttgtttggggtggttgagggttagtgtttttgtattgttttgtttagatttattttatttttaaatttttggttatatttattttttttagatttaagtgatttttttttggggtgatttagggtttgtggttaatagtttttttatgagtttggaagggtttttttaaaattagtttagatttatatgttgtggtgggttgttgtaaatttagatttgtttgtgtttgttttttgttataggtagggtaggtagagttgtggtaagagtttagtttttaggggggtgatgttgtttagtggttagtttatggtttttggatgtagatttttgtatgtaaattttggtttttttgttttttagttttgtagttttgggtaatttatttaatttttttgagttttagtttttttatttaaaaaaatggggatgtgaattattatatttatttgatagggtttgttgtgaggtttagggagttgatatatataaagtatgtagaattatgtttgatgtataggtgagtgttttattatttgttgtgtattagatatggtatttgttgttagtatttttggagttaagttgttagatttaaggattttagttttgggaggaggaatttagaggttgtttttttgagtttttgttaatgtaagagttgagagaagtaaattattttttgagtgtttttgtattttgtattttaggtttttaagttttgagattatgtatatttttagaaggatagtgtggtatgtaggggtgttttataggtagtaagtttttgggtttttattttagttttgttattaattggttgtatgggtttagataagtttttttttgggttttagttttttttttataaagttaggggtaaggtgatgttgattggtttagaggtttttaattttgatgtttttagggttt

SEQ ID NO: 214 - DNA, 2546 bp, Artificial Sequence
  chemically treated genomic DNA (Homo sapiens)
tagttttagtagggattaggtttgggagtgagggtgagttttttgtgtgaattttggagggttggattttaattttggggttgtgggttttgtttttttttttatttatttatttgttttgtgagtattaattggatgtttgtaaagtgttagaggtagtttgtttttgaattagtattttttttaagattggatttattttttgttatgtgtggggaggaaatttttgaattattgaagttagtggttgagtttatattattttagttagtttatagtggttatatttttgttaagtttgttgatgggtagttttattggagtgtagatgttatttttttaggaaatttgtgatgaggattggggtgtatatgtgtgttgaggatattttttaaggttggttttggggtttagataggtaggttggggttatatttgagttttttggttttagtgtatttattttggtgtagatagattatggttgagtgtgtggttttgaattttatttttggaatagaggaagtttttgttatgagaaagaattttagttatagtggatttgtatttgtaggtttgtgttttgtgatatttaagggttaggttggatgggtttttatagaggtggaggagtggttggttttggttaagttgttagatattattagggaaataggtgtatttatagagtttttgtgtttgttgaggggttgggagttgtagttttaaggagtaggtttattttgttgttttttgttttaaggtggttttttttttggttggatgagaaaagttagttgagttttttatggattgatttagtagttgagtatgtagaaattggtttggttttggggttagtatgtgagttattttttattatttataggttttttaggaggttttgtttttgtagtagagtggttgttgttattgaggtaatggttagattaggaattttaggatttttgggagggtgggatattgtggttttattggtttttgtgtttatggaattggtgttagtggatattttgtttatggtgggatatgtttgtaggtgttgggtagatgggggagttttaatattggtttttttagggggttttagtttggaggaaaaaagttttatttttttgatgatggttttattttttaagaatgtattagaatttgttttttagtagttgtttgtggtgtttttagatttgggggtaatgttggttttgtggtttgtttttattttatttaattgtgaatgtttttttattttttgtattgaggtgagatagaggatatggtttttaaggagaggaagaagttgttgggatttttaggttttatgaggttgggttgtttttgagtttgaggtgatttgtagggttgattgatttttatttattgaggaaggttaggatttaattttagttttattttgtgtagttgttatgttagatatgttgttatagattatggtattgttgttttttttgaaagtgttgttttgggtttggtggtgtagtttttggtagtttgtgaggtttgggttgtttgttttttttgtggtataggtttggggatagggtgtgtttgagttagtggttggtttaggaggttatagaggtgtatttgtttttgttttaggtgagtttgggtggttttgggagggtttggggatatagggtgatgtggtgggagggtgttatggtttgttagtttttgattttggggtaggtggttttgtttgtttgttatagaggatggggttttttatttttttgtgagtttttggaggttatgatgtttttggggatattttttttttgggaaggtgagggttggggttgtttttgttgttaggttttggttttaggaaggaggtttgtggttttagtgattaatggatttttttgtttgtttgggagtgtgttgattattagggagtaattagggaattggattttttgtgtggtaggaggggtattttttagtttttgagtttgattgtttttttagtgtttgagttgtatttttgggattttagttttttttttttgagtttgggtagtatttgtgttgggttttgttgggatttttttttttatgtgaggtatgttatggttggtattggttttagtttgggttttgggtgtggtgggtttatagtgtgttagattttgggtgtggtgggttttgggtgtggtggttttgggtgtggtggttttgggtatggtgggttttaggtatggtggttttgggtgtggtgggtttaggtgtggtgggttttgggtgtggtgggttttagttgtggtggttttgggtatggtgggtttgggtatggtgggtttttggtgtggtggttttgggtgtggtggttttgggtatggtgggtttgggtatggtgggtttggttatggtggttttgggtgtggtgggtttgggtgtggtggtttttgaggaggagtgtgttttggagaataggtgggtgtgtgagagtttttagtttagttataagagtaatatatgttgtttatttagttttgttt

SEQ ID NO: 215 - DNA, 2546 bp, Artificial Sequence
  chemically treated genomic DNA (Homo sapiens)
aggtgaggttgggtgggtagtatgtgttgtttttgtggttgagttgggagtttttatgtatttgtttgttttttaggatatatttttttttgggggttattatatttgggtttattatatttgaggttattatggttgggtttattatgtttaggtttattatatttagggttattatatttgaggttattatgttagaagtttattatgtttgggtttattatatttaaggttattatagttgaggtttattatgtttgaagtttattatgtttgggtttattatatttgaggttattatgtttgaagtttattatgtttagggttattatatttgaggttattatgtttgaggtttattatatttagggtttgatatattgtgggtttattatatttgaggtttgggttggggttagtgttagttgtgatatgttttatatgaggaggaaggttttagtagggtttagtatagatgttgtttggatttgggaagggaaagttgggattttaggggtgtagtttaggtattggaaaagtaattaggtttgaaggttgggagatgttttttttgttatatggagagtttagttttttggttattttttggtggttaatatatttttaggtagataagggaatttgttagttattggggttataaattttttttttagggttagagtttggtaatagggatagttttagtttttatttttttaaaggggaggtgtttttaggagtattgtggtttttaggagtttgtgaggggatggaggattttgttttttgtggtaggtaggtagaattatttgttttaagattaaaggttgataggttatagtgtttttttattatgttattttgtgtttttaggtttttttagaattgtttaagtttgtttggagtagaggtaaatgtatttttgtggttttttgagttagttattggtttgggtatattttgtttttaagtttgtgttatgggagaggtgggtagtttgggttttgtaagttgttaggggttgtattgttgggtttaggatagtatttttgggagggataatggtgttgtggtttgtggtggtatgtttaatatggtggttgtataaagtgaggttgaggttgaattttaattttttttagtggatagaaattagttagttttgtaggttgttttaggtttagggatagtttggttttatgaagtttgggaattttaataatttttttttttttttgagagttgtgttttttgttttattttaatgtagggagtaaaagggtgtttatagttaaataaaataaaaatgaattataaagttaatgttgtttttgaatttagaaatattataggtagttattaaggggtagattttagtgtgtttttaaggaatgaaattattattaaggaaataaggttttttttttttaaattgagattttttaaaggagttggtattgaaatttttttatttgtttgatatttatgggtatattttattatgaatgggatgtttgttgatattgattttatagatatagggattggtggagttgtagtgttttatttttttgggggttttggaatttttgatttggttattgttttggtgatagtggttgttttgttgtgggagtagggttttttgggaggtttgtgggtggtgggggatggtttatatgttggttttaggattaggttagtttttatatatttagttgttgagttaatttgtggggggtttaattaattttttttatttaattagaagaaaaattattttaaagtagaaagtaataaaatgagtttgttttttgaggttatgatttttagttttttagtaggtatagaagttttgtgggtgtatttgtttttttggtggtgtttggtagtttggttagagttggttatttttttatttttgtgggggtttgtttagtttggtttttaagtgttgtaagatatagatttgtaggtgtaaatttgttgtggttggagtttttttttataataaaaattttttttgttttaaggatggaatttgggattatatgtttagttatggtttgtttgtgttagagtgaatgtattaaaattaggaggtttagatgtggttttagtttgtttgtttgagttttggggttggttttggagggtgtttttagtatatgtgtgtattttagtttttattataggttttttgggagggtaatgtttgtgttttagtgaggttgtttgttagtaagtttagtaagggtgtgattgttgtgggttggttggggtggtgtgaatttagttattgattttagtgatttagaagttttttttttatatgtgatgaggagtgagtttagttttgaagaaagtgttgatttggaagtaaattgtttttggtattttgtagatatttaattgatatttatgggataaatgaatgaatggagggaggggtagagtttatagttttagggttagggtttggttttttagggtttgtgtaaggggtttgtttttatttttaggtttggtttttgttggggttg

SEQ ID NO: 216 - DNA, 2251 bp, Artificial Sequence
  chemically treated genomic DNA (Homo sapiens)
ggattttgagttgtttttaggtagttaggagtggttttagtggtagttgtaaattttagtagttgtttgtgttgtttgtggttggggtggagggtagttagagttggggattaaggttttgtgttatttgtgtgtatagttttatatttgaatgttgtttttttgtagatgagattggtgggtattgtaaagttgggatttgtttttgaaggaaaaaaaatagtgagtaagaaatttagtattattttttattgatttattttgttgtattttttgttttttaagtttttgaaagttggtaattttgattttggtgtttaaaaattgatagttattgagattggttttgagaagttgaagatttggtagtttttagattgagtaggataaggtgaaagtaggttggaggtgggtttaggatatttgagggttgattttgggggtttgtgaggttgttattgttgttgttgttataggtgagatggtgttgggttgatgttggggttaatgggtagagaatgtagggatgtggtttttgttgaagagagttaagaagggaagagtgtgttttttaaattgtttttgtaatttgtttttagtgagtattttattgatttagaatttattgagaatagtattagtgagttattttttttttgagatgggttttatttattttggtaatggagtgagttggattgtggggaggaagaggaatgggaaaattagtttataaatattaatgttagtaagagtgtgttgttggtaggatgtattgtgagtttggagattttggtggttgtagttggtaagtggttataatttagaaagtaggattgagttgttttttttgttttattagtgtattgttttttgggtgtgggtttaatattttataagtggtaatttttgtttatggtagttttgttttttttttattatttttagatttagttttgtattttaaggttgtgtattgttagttattattatgtttatttttggggttaatttgtttgtttttttgagttttgattggttgaatagtttagtgattattttggtggtgatgtttatttttggggtggtgggtaatttggtggttattgtggtgttgtgtaagttgtgtaaggagtagaaggagatgattttttatatgttggtatgtgggttggttgttattgatttgttgggtattttgttggtgagtttggtgattattgttatgtatatgaagggttaatggtttgggggttagttgttgtgtgagtatagtatttttattttgtttttttttagtttgtttggttttagtattatttgtgttatgagtgttgagtgttatttggttattaattatgtttatttttatagttattatgtggataagtgattggtgggttttatgttttttgtagtttatgtgtttaatgtgtttttttgtgtgttgtttaatatgggttttggtagtttgtggttgtagtatttagatatttggtgttttattgattggattattaatgtgatggtgtatgttgtttatttttatatgtatgtgggttttagttttttttttatttttgttattgttttttgtaatgtgtttgtgtgtggtgtgttgttttgtatgtattgttagtttatgtgttgtattttgttgggtattgagtagtattatgtggttgtggttgttttggttgttttttggggttattttgttgtttttttagttttgttgtgttttagtgatttttggtgttgttggagtttttgttgtattgtgggtgttgagatttagatggttattttatttattgttatttttttggtggtgtttatttgttttattttgtttgtggtgagtgattggggttggggttttatttggttttttttttgtatttattttttgtgtttattttttgttttttgttttttttttgagtttttggtagtgaatgtgttgtttttaggttggggttgggatttttatattgttttttagagtaggtttaattttttttgaagttttaattttaatgagatttagtaggtgttttgtttttatattttttagtttatgtttttggaagtttgggtttttttttttattgagatagtttttattttttgttgtttgatattggttgagttttttaagaaaattttttgttttttttgttagatgtggaggggagtttgttgtagtgtgatttagtttatttttttgtattgtgaattgtgaattgta

SEQ ID NO: 217 - DNA, 2251 bp, Artificial Sequence
  chemically treated genomic DNA (Homo sapiens)
tgtagtttatagtttatagtatggaggaatgggttaagttatattatagtaggtttttttttatgtttaatagagggggtggggggtttttttggaagatttggttagtgttaggtagtaaggggtaagggttgttttggtggagaaagaaatttaggtttttgggaatataaattgggggatgtaggggtaaagtatttgttaaattttgttagggttgggattttaaagagggttgggtttgttttgagaaatagtgtgggaattttagttttgatttaaaggtgatatgtttattgttaaggatttagagggaaagtagggagtggggaatggatgtgggaggtggatgtgagaaaaaggttgagtagggttttagttttggttatttattatgagtgggatggagtagatgagtattattagggaggtggtaatgagtaagatgattatttggattttggtgtttgtgatgtggtggaagttttggtggtgttgaaagttgttgaggtgtggtaaggttggggaggtagtggggtggttttgggaggtaattgaggtggttgtggttgtgtggtgttgtttggtgtttagtgaggtgtggtgtatgaattggtggtgtatgtggagtagtgtgttgtatataagtatgttgtagaggatggtggtgagaatgaggaaggagttgaagtttgtgtatatgtaggagtaggtggtgtgtgttgttatgttggtggtttagttgatgaagtattaggtgtttgggtattgtagttgtgagttattgagatttatgttgggtagtgtgtaaaagagtatgttggatgtatagattgtaaagagtgtgaggtttgttaattgtttgtttatgtagtggttgtagaaataggtatggttgatggttaggtagtgtttgatatttatggtgtagatgatgttgaggttggataggttgaagaagagtagaatgaaggtgttgtatttgtatagtggttggtttttgggttattggttttttatgtatgtggtgatggttattgggtttattaataaagtgtttaataggttggtgatagttagtttatatattagtgtgtagaaggttgtttttttttgttttttgtgtgatttgtatagtattatgatggttattaggttgtttattattttgaagatgaatattattgttgggatggttattgggttgtttagttggttggggtttaaggaggtggatgaattgattttgggagtggatatgatagtggttggtggtgtgtagttttggagtgtaaggttgggtttggggatggtagaagagagataaagttgttgtgagtggaaattattatttgtaaggtgttagatttgtgtttgagaaatgatatattgataagataaggggagtaatttgattttattttttggattgtagttatttattaattgtggttattaaaatttttaggtttgtgatatgttttgttaatagtatatttttgttgatattaatatttataaattgatttttttatttttttttttttttataatttaatttattttattgttaagatgaataagatttattttaagggaaaagtagtttgttagtgttatttttgatagattttgaattaataaaatgtttattgaaaataagttataaaagtaatttggagagtgtgtttttttttttttggttttttttggtgagggttgtatttttgtgttttttatttgttgattttaatgttagtttaatgttattttatttgtagtggtagtagtggtggtagttttatgagtttttagggttagtttttagatgttttggatttgtttttaatttgtttttattttgttttgtttagtttggaaattgttaaatttttggttttttaaagttggttttagtggttgttgatttttggatattgaggttagagttgttagtttttaaaaatttgggaaataagaggtgtagtgggatgggttagtgaagaatggtgttggattttttatttgttatttttttttttttaaagatgagttttagttttgtagtgtttgttggttttgtttgtgggaggatagtgtttaggtgtgaggttgtgtgtgtaggtggtgtggagttttggtttttagttttggttgttttttgttttagttatgggtagtatgggtggttattggagtttgtggttgttgttgaggttgtttttggttatttgggggtggtttggggttt

SEQ ID NO: 218 - DNA, 2413 bp, Artificial Sequence
  chemically treated genomic DNA (Homo sapiens)
tggttaattgggtttaaaggaagatattggtttaaatattgaaattaattagatttttttatggtttttttgttattagatgatattggtgtaggggtggttgttatgtatagggtagagttatttaatttttatgtaggtgttgtgttttgttatgttggtttttttttggttattatattaggttaagtaggggagaggaatgggaatgtttatgtatttttattaattttgtagatatagaattatgtatagtttttgggaggagttagatgagttgtttaaagtttaggagggatttgtatagtggttagtgtggtagggatggtgttttagttaaggtagggatggtgggtgatttatttaggatttttaaggaggttgttgtatttttgtgttttttttagataataaggatgtgttggtgatgatgagtgagatggatgtgaatgttattgtaggtatgttgaagttgtatttttgtgagttgtttgagtttttttttattgatgagttttattttaattttgtagagggtattggtgagtattggaggttttggttttatgggagatgttttttttatgtgtattgttgtttttggaggttgtgaaaagtgaggtgtgggaatttgagttgtaatttttttgttgtggttggtattttaatttaattttaaaaagtaggggattagaattgagtttgttttggaaggttttgtttatttttagagggttttttatttttattttttaaggagattaagaggttgaaatagttagtattgttgtgttatggggttttaaagtttgttgtttttttttttgtagattagggttgaaggagggtgtttgggtgtttttgttatgggttttggtttagttaagtatggttttaaatatgatttgatttttagttaatttggaggttgatgtttagagtgggtgttggtgtgtgtagtatttgtggtttttgtattatttttagggtaggtttgttttttgggtttatgtatagaggatttggttttttagtttgtaggtgtttttgtggtgtttaggatgatgagggggtttttgtgtatttggtggggttgggatttttttattttttatttttttgtgttttttatttttttgttttattttatgttgagttttttttgttttgggttttttggggagggggtggtggtaggagttgtttgagggtagttttgtttatgagtagttgttttagtggttttttttgttgttgtttgttgggtgttgttgatttttgtgaggtagagaaaaggtgtttaggtggtttatattttatataggtgttttttatagggtttttattggtggttagtgttgtgggtgtgatgatgatgataagtttaaattgtgtaaggatttgtgttttgggtgttttatgtgattattttgggagaggtttttggtttgttgtaatttaggggagtgatttattgttttttgtagtttttttagatttagttgtaaggaagagttgtatgtttaatttgttgttgtttttgttggaggttaatttgtttattttttttttttttttagattatttggaaaggtagtttagtttttttgtggttgtttaggattttaggtttttaggttgttggggtgtttttttgtttttattagatttttagtattaaggatttttttttttgatttttgtttgtagtaatttattgtttttaaggattagtattattgttatttttatttttgttttttttttttgttatttttttttttttgtattgtggttttaataaagagtttagagttttggttgtggttagtagtgtatttggatttttttttttttttttaagtatattatgaagatttttttattagtttagagttggttttttgttttgggttattgagatttagaagtattaaggttggagttagtttgtagtatagttagggttgaggttattttttttttgaggattttagtatggtatagtttttttgttttttttttggtggtggtgttgaaatagtattttttgttttggttttttatagggtggtagagaaggaggtggttaataaggtgtttttgtataattttgttattgtttttggttttatgttgttttggttttttgagaaggagagtaagttttttgttaattttagttagtttgttattatgattgatagtaggtttttggaggttatgttttaggtatgggaagatagtttttagtttatgtaattttagtttgatagaggtggtttttgtttgttttatttttagttttgtttattttttgatttgtattgtatgtggtggtggttgagatttagagagagggatttgtttaggtttgtatggatgggagtgatagggggtgtttaggttattt

SEQ ID NO: 219 - DNA, 2413 bp, Artificial Sequence
  chemically treated genomic DNA (Homo sapiens)
aggtggtttgggtattttttattatttttatttatgtaaatttaggtaagtttttttttttgaattttagttattattatatataatgtaagttggaagatgggtaggattgggggtggggtaggtagaggttatttttgttaggttggggttgtatgggttggagattgtttttttatatttgagatatgatttttaaggatttgttgttagttatggtgataggttggttggggttggtagggagtttgtttttttttttggagggttggagtagtgtggggttaaagatagtggtgaggttgtgtagggatattttattgattgtttttttttttgttattttgtagaggattgaagtagagggtgttgttttaatgttattattaggagagaggtagaggggttgtgttgtgttagagtttttagggagggagtgattttgattttggttgtgttgtaagttgattttagttttggtatttttgggttttagtggtttaggataaggggttagttttgggttgatggggaggtttttatgatgtgtttgggagggaagaggggggtttaagtgtattgttggttatggttaaagttttgagttttttgttaaggttatagtgtagagggaggagggtggtaaagaggagaggtaggggtgggggtggtagtggtgttagtttttagaagtagtgagttattgtagataggggttgggggaaaaggtttttggtgttgggggtttggtgggagtagaggggtattttaatggtttggagatttggagttttgggtagttataagagagttgggttatttttttaggtggtttagaaggaaaaggaaggtgagtaggttggtttttggtagggataataataggttgagtatgtagtttttttttgtaattgggtttgaaagagttgtaggaggtagtgggttatttttttgggttatgataagttggagattttttttgaggtggttatatggagtgtttgggatatgagtttttgtgtagtttaggtttgttattattgttatatttatagtgttggttgttagtgaggattttgtgaggggtatttgtgtggggtgtgaattatttgaatgttttttttttattttgtaggggttagtagtatttggtgaatagtagtaggaggagttgttagagtagttgtttatgggtagagttgtttttgggtaatttttgttattattttttttttagggagtttaaggtaggggaggtttagtatggaatgaaataggggagtgagggatataaggaggtgggaagtgggagggttttagttttattaagtatatagagatttttttgttgttttggatattataggggtatttgtaggttgggagattaggttttttgtgtatgggtttgggaggtagatttgttttaagggtgatgtagaggttataggtgttgtatgtattagtatttgttttagatattagtttttaggttgattaagggttaggttatgtttgaaattatgtttggttggattaggatttatggtaagagtatttaggtatttttttttagttttggtttgtaggaaggaggatagtagattttaggattttatagtatagtagtgttgattattttagttttttggtttttttgaggagtagggatggggagttttttggggatgggtaaggttttttaggataggtttggttttggttttttgttttttgaggttgggttaaaatgttgattatggtagaggggttatagtttaggtttttatattttgttttttatagtttttgagggtagtagtgtatgtggaggagatgttttttatgaggttaaggtttttagtgtttattgatgttttttgtgaagttggggtagaatttgttagtgaagaggggtttgggtagtttatggaagtatagttttagtgtgtttgtgatggtgtttatgtttattttgtttattattattgatatgtttttgttatttggaaagagtatggaaatgtagtggtttttttgaagattttgagtgagttatttattatttttgttttggttaaagtattgtttttgttatattgattattgtgtgggttttttttgggttttgagtagtttatttgattttttttaagagttgtgtatggttttgtgtttgtagagttgataggggtgtgtgggtatttttattttttttttttgtttggtttgatgtgatggttaggaggaggttaatgtggtaggatatagtgtttgtgtggggattgggtggttttgttttgtatatagtaattatttttgtattagtgttgtttgatagtaggaaggttgtgggagaatttgattggttttagtgtttgaattggtgtttttttttggatttaattggtta

SEQ ID NO: 220 - DNA, 2222 bp, Artificial Sequence
  chemically treated genomic DNA (Homo sapiens)
tttattaagaaaatatttgtttataataatggtgtagaatgaaaagaggaaaatgttgtttttattattaaggtgaaattgtttattattaaaggttttttttaagttgtatgtaagtttttttatttggaagtgttattatttgtaataattttttgtaatagtttattggtttagggagttaaaatattatattgtgggtgggaggtgggggttggtttgaaggaggatggatagtgagggtgttttgtggattttaaatgtaagttattaggtttttggtggtttttggtgtttaattttattttataaaagtggtatgatggaatatgattaggtaaaattttattttttggtattgtggtggtatttttttttttttttttttttattagggttaatatgtttatttttatgggaaatatatataaatattaggaagatttgttttgtattgagattaatagtattagttttgtaaaagtagtttgataaaaggttttatatatttaatattagagattagaaatagattaaaaaaaaaaaaaaaaaaaaatatatattatataattggtaaatttattaatttaggtttatttaatttttgtttttatatatgtgttttaaaataatttataataaaaatggaagggaagatagatttaatttgaaattttttttgagaaaaaataaattaaaattagtttttggggaagaaagttttagttaggttaggaggaaatttatgtatttttgattttttttttgttttggagaggtattatttgtttaagtttagttaatgtggttggttaggatttatagtttttattaagggttagattttgtgaaagatataaagaaaggagttttttaatatattgggtttttttatagtaataagatattgaaattaagttttttatggtttgtgtttgtaggattttttagataaaattggtagttttattagataagaaatggttttttagaagttttgggggaagtgtgggggttttttgtggtttttttgtgattgtttttgggagattgtaatagatgatgggaatatgtaagaatgattgaagaaggttattggtgagttgtatttaatagttttttttttttaagtagttttttgagagaaaattatatattaatgtttggggatgtgaaataggttttttattgttttgtaataaatttttttttatttgtgtttttagattaatgtatttttaaaaaatttttataaagttatggagatttgtttttataattattaaaatattatagttagttgtataagtttgtttaaaaataaagggtaggagattagtagtgagaagaattgaatagtatataaaaattttataaattttagattattgaaagattattttgttttttggttttgggttagtgagttttaattttagagttaaattgagaagtagattttgtgggtttgaaagataaaaagttagtttgtggagttaattttggtttattggtgtgttttaatttgattgttttaatagtaagaagtgtttttttttttttatttaatgtttttagatatttgaggttgggggagatggagtaatggtgtagtagttaggaaatagtttttttgggtttaattattttatttttgatttttttttttttagtgtgttgagtgtagttagttttggaggaattagttttttggagtagttaaggtaggttaggttttggggatgtgtattatggtgtggggattaaattaagttgaatggtttgttttaagtttttttttttttttagagtttgggagggattttgttaataggtagatttatttattagttatttgttattggtggtagaaagtgagttttgtgtgtaatgtggttagttggattgtggggattttaggagtgtagggtggaggagtagtgttataggaggtgagggtgtaggtggtgtggttgggaaggaatgtgggaggggatagaaggaagaggaagaggaggagagggaggttagagttagaatagtttggtagtttgagttttgggggagaatggtttgagttttgagtaagttgttttgggagttttaatttttttttgttggtttgttgagtggttagtggtgtttagtggtggtgaggttgaaatatgataattagaatagttgtgttgtgtgttttgtagttaatgggtgtggtgtttgtt

SEQ ID NO: 221 - DNA, 2222 bp, Artificial Sequence
  chemically treated genomic DNA (Homo sapiens)
ggtgagtgttgtgtttattggttgtagggtgtgtggtgtagttgttttgattattatattttagttttgttgttgttgagtgttattgattgtttggtgagttagtgggagaggattagggtttttgaggtaatttgtttggggtttaggttgtttttttttgaagtttgggttgttgggttgttttggttttggttttttttttttttttttttttttttttttgtttttttttgtgtttttttttggttgtgttgtttgtgtttttgttttttgtggtgttgtttttttgttttgtgtttttggggtttttgtagtttggttggttgtgttgtgtgtggggtttattttttgttgttggtggtgagtggttggtgggtaggtttatttgttgatgaggttttttttgggttttaggaaaaggggggaatttggagtaggttgtttagtttggtttggtttttatgttgtggtgtatatttttggggtttggtttgttttggttgttttggagggttagtttttttagaattggttgtgtttggtgtgttaggggaagaagaattgggaatgggatgattaaatttagaggaattgttttttgattgttatattattattttgttttttttaattttagatatttaaaaatgttgggtgggaggaaaggggtgttttttgttgttgggataattaggttggaatgtattggtaaattgaagttgattttgtggattgattttttgttttttagatttgtgaggtttgttttttagtttaattttagaattgaagtttattaatttgaagttaaagagtgaaatgattttttagtagtttaaagtttgtaagatttttatatattgtttaattttttttattgttggttttttgttttttgtttttaagtaaatttgtgtaattagttgtggtattttggtaattataaggataagtttttatgattttgtggagattttttaaaaatgtattagtttaagggtgtgagtagggagggatttattatagaatagtgaaagatttattttatgtttttaggtgttaatatataatttttttttgagaaattatttggagagagaagattgttaggtgtaatttgttggtaattttttttaattatttttatatgtttttattatttgttatggttttttaaagatagttataggaaggttatgaagaatttttgtgttttttttaaagtttttaaaaagttattttttatttaatggggttgttagttttatttaaaaagttttatagatataaattatagaaggtttaattttggtgttttgttgttgtgagaagatttggtgtgttaggaaatttttttttttatattttttgtaaaatttaatttttgataagagttgtaaattttggttggttgtattggttgggtttgaatgggtaatgtttttttaaagtggaaagggaattaaagatgtgtaagtttttttttgatttagttgaggtttttttttttaggaattagttttgatttgtttttttttaaggaggattttaaattggatttgtttttttttttatttttattataagttgttttagagtgtgtgtatgaaagtgaaagttggatagatttaggttgataagtttattagttgtgtggtgtgtgtttttttttttttttttttttggtttgtttttagtttttggtattagatgtatggagttttttgttaggttgtttttgtaaagttgatgttgttaattttaatatgaagtaaatttttttagtatttgtgtgtgttttttatagagataaatatgttgattttagtaaaaaaaaaaaaaaaaaaagatattattataatgttagaaaatagagttttatttagttatattttattatgttatttttataagatggaattaaatattagaagttattagaagtttgatgatttatatttgagatttataaagtatttttattatttatttttttttaaattagtttttattttttatttatagtgtggtattttaattttttaaattaataagttattataaagaattattgtagatgatagtatttttaagtagaaaagtttgtatgtggtttgggggaaatttttagtaatagataattttattttaatggtgaagataatatttttttttttttattttgtattattgttgtaaataagtatttttttaataag

SEQ ID NO: 222 - DNA, 2162 bp, Artificial Sequence
  chemically treated genomic DNA (Homo sapiens)
tggatttagaaagggtgaattatgagggagttggagggttttgttttatttttttttgtgtgtatatgtaagtataggtagaggtatatattttttttaagttaaagttgtgagtggggtggtgtttgtgtgtttgtggttgggattggatgtgttagggatgggaaaatttattatgttggttatagaaaatgtgtggtggggatagaagtagttttgaaggaaaagaagaggagggggattgaaagaaagaagggggtgttgaaagggagggtgttgggaggaaaaaggtgtagtgtggaggaagtgtggtgtgggtagggtttgggaagggataatggaatatttgaggtggagtgggttgtggagtgttggggttggtttgagtagtgggtgtgtaaatggaatagttttgagatgaattttatgggagtttgtgtaggtttttaatgtgtggttgtattttttagttttatgtattttatatgatggatagatagttttggtgtggtagggtttaaagaggttttatttattgtaataatatgattaggtggttttgggggtgtaggggtttggggtgggagtggtggagtgtgtggagttgttgtggggtggtaggggtgggttgggggtggggttgtgggtgttggggaggtggtagtgggtgtagggtggggtgagtttagtggagggtgggtttgaatgtgttttggtgggagagggaagttgtagtgagagtgtgtggattttagtgtgggagtagtgtttttgtggtaggtgttgtttggggttggggattggggattggggattgttggggtggaagatgttgttgtttgtttgttatggagggtagggagggtgggtttgatggttttgtagtttggagaagggatgttgggtggggttttagtgtggagtgtgtggagttgtgtagtatgtggtgtgtatgggttagggagtttgaggattttgtggggattgggatttaagttgggtggggtggtttggtttttgggtttaaaataggttgtggttatgttgatttttgtaaggggtaggtgagtggatgggtgatttttattgatttggttggtattagggaggggttgtgttgttgattgtgttggtggaggggtatggggatggggatggggatggaggtttgtgagtggaggtgtaggtttgtgagtggaggtgtggggttgtttttttaattttggttttttattggttaaatttgtatttttggtgttttttttttgtgtatgtttttatttattgatttattgtgagggtatatgagagggtgaagataaatagtttttggttttgtttattaggagagagtagttgtaggttaaggttggttttaattttgtttttatatttttaggggtttttttgtagttttgtggtagtttttttgtttattttttttggtggtttttagattttttaattttttttttgtttgtgtaagttttttatgttaggatgtgtgtgatggggtggggttgagttgtttgatatttaagttaggttgggaatgattttggtttttattttatttttttttttagttgaattagagttttttttattttttagtttatagggttaattgagaagtagtttttatatttttttttattttaaaaggagtttgaatatttaatatggattttagtttttttatttattagttttgtgattttaggtaagtgatttaatttttttgaattttagttggttttatttatttagtgttagtattagtttatgggtggttgtgaagaaaagataagagatttgtaggtagtggttagttttatatgaaattttgggagtggagaattgtaggagaggtgttgggagtttggaggtagggaggtatttaatttggtggttatttttaggggtttattttagtaggttaaggtatagttggagggatattagatgttttgagttggtattagatttttgtttgttgttgggtaaaggtagataaaagtaaaatatgaaggttggttagttgaatgttaggatatgggtaggaggagagggttggagttgaattgtgtttaagattggtatgggaatttttgagaatagagagagtaggggtgtagtagggggttagggaagaaataaat

SEQ ID NO: 223 - DNA, 2162 bp, Artificial Sequence
  chemically treated genomic DNA (Homo sapiens)
atttattttttttttggttttttgttatatttttgttttttttgtttttaggagtttttatattagttttgggtataatttaattttagttttttttttttgtttatattttaatatttagttggttagtttttgtgttttgtttttgtttgtttttgtttagtggtaaatagggatttgatattagtttagagtatttggtgtttttttaattatgttttggtttgttgaggtgggtttttgaaagtagttattaaattgagtatttttttgtttttagatttttaatattttttttgtaattttttatttttaggattttatatggggttagttattatttgtagattttttgttttttttttataattatttataagttagtattagtattgaatagatggggttagttgaggtttagaggggttgagttatttgtttgaagttatagagttggtgagtggaggagttagaatttatattaaatgtttaagttttttttggaatggagagaggtataaaagttgttttttagttagttttgtagattgggaggtggggggaattttgatttaattaaagggaaaaatgaggtggagattaagattatttttagtttgatttgagtgttaggtagtttagttttgttttattatatatattttggtatggggagtttatataagtaggaggaaagttggagggtttggaggttattgagaggagtaggtaaagggattattatagggttgtagagagatttttagaggtgtgagggtagggttggagttagttttgatttatgattgtttttttttggtaagtaaagttgaggattgtttgtttttatttttttatatatttttatagtaaattagtaaatgaagatgtgtgtaggaaggagatgttagggatatgagtttagttagtaaaagattggggttaaagagatagttttgtatttttgtttgtgagtttgtatttttgtttgtgagtttttatttttatttttatttttatatttttttgttagtgtagttagtggtatggtttttttttgatattgattagattgatggggattatttgtttatttgtttgttttttgtggaggttaatgtgattgtagtttgttttaggtttgggagttaggttgttttgtttagtttgggttttggtttttgtagggtttttaggttttttggtttgtgtgtgttatgtgttgtgtggttttgtatgttttgtattggggttttatttggtgttttttttttgggttgtggagttgttaggtttgttttttttgttttttgtggtaggtgggtagtggtgttttttgttttggtagtttttagtttttagtttttggttttgggtagtatttgttgtagaagtattgtttttgtgttgagatttgtgtgtttttgttgtagttttttttttttgttggggtatatttaaatttgttttttgttgagtttgttttgttttgtgtttattgttatttttttgatgtttgtggttttgtttttggtttatttttgttattttgtggtgattttgtgtgttttgttgtttttattttgagtttttgtgtttttagggttgtttggttgtgttattgtggtagataggatttttttgggttttgttatattaaggttgtttgtttattgtgtggggtatatggggttggagggtatagttatatattaaggatttgtgtagatttttataaaatttattttgggattgttttatttatatatttgttgtttagattggttttgatgttttatggtttattttattttagatattttgttatttttttttaagttttgtttatgttgtgttttttttatattgtatttttttttttttagtgtttttttttttagtgttttttttttttttttagtttttttttttttttttttttttaaaattgtttttgtttttattgtgtattttttgtgattagtatgatgggtttttttatttttgatatatttagttttagttatagatgtgtaaatattattttatttataattttgatttggagggggtatgtgtttttgtttgtgtttgtgtgtgtgtgtggaggggggtggggtaaagttttttagtttttttataatttattttttttaaattta

SEQ ID NO: 224 - DNA, 2586 bp, Artificial Sequence
  chemically treated genomic DNA (Homo sapiens)
tttgtgtgggtgtgggagtagttttgttgggtgtttgtagttgtgggagttaagttttttttttaggtgtaggtataaaagtttatggtttttgaataatgtggggtagaggtttttttaagtaatgtttaattggttgtttttaattaaggaaagagaggtttttagttttatggtaatttaagtagggtagttttaggttaaaggtattttagaataataagattattttaagaaatggaatgttttattggatatttgaataggttttttgttattggaattggtgtgtattgtattttaattagtatttttgtgtggagggaggtgatttagtttaggaaagttaattatagaaagaggtgatttttgaaaggattgttttagtgttattagaatatatgtgattatattaaaagtttaggtggatatttgtagttagtttggatttggataatttaatattgttggtagaattgaagggaataagttattttaattttattttttgtatgtgtagtgttgagtgagttgggggtgggaggatagtggtttgtttattgtttttttttaaaatttgagatttgaaaatatggaggttttatttgtttttttagtttttgattgttaataaaaaaataaattttgttggttatattttttttttattttaaaatagtaattttatggtttgtattaagttttttagaagtttattttatttgttttgggttagggagggaataatgttaggaaaagttattggtgtttttttatttttgttttttttagggtgtaggatgtgtgggttggtgggtttgtgattttggaatgttttttgttatttttttgtgtgaatttgaaaggattgggaggtgttgagagtagagtttagggttggtgtattttgtggtgttgagtgggtggtgtgtttgggtgtttaggttgggggatttgtagttgttttattgtggaggggaaaatatgtagttggagggtgtgtgttgtgtgggttgtgatttgttattttattggttattttggggtttttttaagtttttaggtagggttgtgagagttttttagagttgaagttttggaggttgatttgtgggtttggttgttatgggaatttggttggtttaaagaagttttttttttgggtatttggaattttagtttagtgtggggtattggggaagtggtgttggggggttgggttgggggattttagttggtagttttggagagggtttatttttggggttgttgggtgaggttggtatgatttttggttttaaaaggaaagtttttgttttttgttttggtgtgagaagttaaagatttattttgagagtggagagagaaatgttattggtaatgttttttttggaaagtttgagaggggttttttggatatattatttagtgtttttaaattagagaagtagtttttttttggtgtttgggtttagaagttgttatttatttagtttatggtttgaaattagtatgggaagtgttggggtaaggttttgttggagattagaggtttgtttgttgggaggagtttttgggggatggggattttatttttttgtttgttttggtttttatttgggatgtttttgtaggagtttagaaagatgatttattatatggttttgggatagagtagtgtgtttaattttgagggaattttgtgtgtttttttgaggttttagttttttaaggtattgttgtttgtttttttttttttagattgaaattggggaagagtgtgggtgtttttttgttttgatgagtttgtttttttaaatgtttattttggttgtattagagtatttgggaaattttgaaaggtgtttaggttttatatagtagtgtttttttatttagtttttgtttttgggtttttttaagagagtttttattttatgttttggtttttttttgatgttgggtttttgaggtaggtatggagtttttttgaaagtagttgtttatttgtgtttttttggtgtaaagttagagtttattttgttgggggaaggggaggtagaaaagattatagttgggaaagtgtgttttttgttttgtttttaaaatatgttttaagattgttattgtgattgttaggagagttattaatgtttaggggttataaaggaatttttgaatttttggttttttttaaatttttaggtttttaaaattttagtgggggttttttggggttgggatttaggttggtattgttgggaggattttgtttagtatttttttattaatattttatgaaggtaggtttttgttttttttggagtttttttttttggaatgtttttaaattttggttaatttatttttttgtgagttattttagggttttgtggtttgggaagagatgtgttaattttgtgggtttgtgtgtagtttttagttgtaaagtgttgtaagtgatttttttgatggttttttttgattgaagagtttgggaattaaagagaaaaaaaataattttatttttaaaagaataagttattattgtggtgatattgtggtggaggattttggtgatggggt

SEQ ID NO: 225 - DNA, 2586 bp, Artificial Sequence
  chemically treated genomic DNA (Homo sapiens)
attttattgttaaagttttttgttatagtattgttgtagtgatgatttgtttttttgaaaataaagttattttttttttttttggtttttgagttttttggttggaaagggttgttaggggggttatttgtagtattttgtggttaaggattgtgtgtagatttgtggagttgatgtgtttttttttgggttatagagttttaggatggtttataggggagtgagttagttagagtttgggaatattttgagaaaagaggttttagagaaggtaggagtttgtttttgtgaaatattaataaagggatgttaggtgaggtttttttagtggtgttagtttgaattttagttttaagagatttttattagggttttaggaatttgggggtttgggaagggttgagggtttagaaatttttttatagtttttagatgttgatagtttttttaataattgtgatgatagttttgaggtatgttttaggaataaggtgaaaagtgtatttttttaattgtgattttttttattttttttttttttaataaagtaaattttaattttatattaaaggggtatagataggtaattgtttttagagggattttgtgtttattttggggatttgatattgaagaaagattgaggtatgaggtagagatttttttgaaaaaatttaaagatagaggttgagtagggagatgttgttgtgtgaggtttgggtattttttagagttttttagatgttttggtgtagttgaagtaggtgtttggggaggtgaatttattggggtaaagaagtgtttatatttttttttagttttggtttagggaaagaagaatggatggtggtgttttggaaagttagggttttagagaggtgtataaagtttttttaaagttgggtgtgttgttttgttttgggattatgtagtggattgtttttttgggtttttatggaggtgttttaggtgggaattagagtaagtaggagaatggggtttttattttttaggggttttttttgataggtaggtttttagtttttgatgaagttttgttttggtgttttttatgttgattttgaattatgggttgagtgagtggtgatttttgagtttaggtattaaagaaaaattatttttttggtttgggggtattaggtagtgtgtttagaagattttttttgaattttttaaagaaaatgttattaataatatttttttttttgtttttaaaataagtttttggttttttgtgttagaataagaagtagaaattttttttttggagttaagaattgtgttggttttatttagtgattttaagggtaggttttttttggagttgttggttgaggttttttaatttagttttttagtgttatttttttgatgttttatattaaattggaattttaggtgtttggaagaaaggtttttttggattaattgggtttttatagtagttagatttataggttagtttttggggttttagttttaggggatttttatagttttatttagaggtttggggagattttaggatgattgatggggtaatggattataatttgtatggtgtatgttttttagttatgtatttttttttttgtggtagggtgattataggttttttggtttgagtgtttgggtgtgttgtttatttagtattgtagagtgtattagttttgaattttgtttttaatattttttagtttttttaagtttgtgtaaggggatggtaggaagtgttttgggattataggtttgttggtttgtatattttgtattttggaaggggtgaggatggaagagtattggtgattttttttagtattgttttttttttggtttagagtaaatgagataaatttttgaagggtttaatataagttatagggttgttattttggaatgaggagaaaatgtagttagtgggatttgtttttttgttggtaattaagagttgggaaaatgaatgggatttttatatttttagattttagattttaaaagggggtaataaatgaattgttgtttttttatttttaatttatttagtattatgtgtataggggatggggttggggtaatttgttttttttagttttgttagtaatgttgaattgtttaaatttgagttggttgtgggtgtttgtttgggtttttggtgtggttatatgtattttaatagtgttaagataatttttttggaggttatttttttttgtagttgatttttttagattgggttgtttttttttatataagagtattggttgaagtatagtatatattaattttaatgatagagaatttgtttgggtgtttagtgagatattttattttttagaatgattttattattttaaagtatttttagtttgaagttgttttgtttgggttgttatagagttggaagtttttttttttttaattagaagtggttaattagatgttgtttggaaaaatttttgttttgtattgtttaagagttataaatttttatgtttgtatttggggagggggtttgatttttgtggttgtgagtgtttagtggggttatttttgtgtttgtgtggg

SEQ ID NO: 226 - DNA, 2257 bp, Artificial Sequence
  chemically treated genomic DNA (Homo sapiens)
gttgggttagtttggattgtggagttgtgtttttaatgggaattttggagggtaggattttgatttttttttgaatttttaaataggagtttgaatagaaatatgtggatttagggattagtgttttgggtatattttgatagtgatatagttgttttgatagggttgtggttttttttgttttgttttttttttgtgtttttttttatatttttaggggttgtttgttgttagtttttttgttgtggttttatttagtttttgttggtgtggtttgatttttaaatgtgtgttagtaaggtttgtgttggagggaggggagggtttggatgggtttggatgggttggtgttagtatttgggattaaggagggagtttgtagaagggatagtttttggttaggtgggatttgaatgatattttgtggtatttaatgggtttgaggtgtttgtgtgattatgaggagaagtggaggatagtttaggtgaggatattagatttaggagtgggtgaggagtttttgtagttaggttatgtgaattttggtttagtagggttagtttgattttttgaaggtgggagattttttgaaggtgggagatttgtgagttggtatatttagtgaggatggttttatgtatagggatgaagatttttgaggagattattgaaggatggtgggtagtgttgtttatatggatgtttagagtgtgttttttaagattagtgggttttatgttgtttatatgtttttattaggtgattgatattagggtttgtttgtgttttgtttgggtggggttagttatgtttttggattattgttttaattagtgtttgttgttagttttttatatgggatagggtattgtagattggtttgggaatttggggatattttatgttttatattttttattgttttttttgtattagaatagtttaggggaaggaaaggtatagaaaataaataatatatagtagaggaggttttgtttttgtttgattgaaggtaattttttttttgaagagaaaggtgtagataggttttttttttttttttttttttttattttatttaattttgggtatttttttagtttgaaatttgtttgagtgagataagagatattgtgggtttaatgtgtttgtgaggttttttttttattggttttttgtgtttttatgttttagttaaatataaaagtgagatgttttttgtttagtttttttaattttgtttagtttttgtgtttttttaagttttatttgtagaaggttgagttttatgtatttgtattttttttttttggtgtttgtgtttaaatgtgtggttttgtttggtttaatttttttttgggttttgtggttgagttggtttgttttttagttttagttttattttttggtttttttagttttgtattgtttggttggttttttagttatttggttttgtattgtttagttatgttatttttttggtttttgggttttgtattgtttggttagtttttttgttttttggttttgtattgtttagttatgttatttttttggtttttgggttttgtattgtttggttggtttttttgttttttggttttgtattgtttggttggttttttagtatttgtttgggtttttttatttttttgtagattttaggttgtgtttagagagagttgagtttggtggtttaggtgttttattattggtttttagttttttttttttttggtagtttttatgagagttttaaaggaattttttagtgaagttgtttttttgtttttggagttttggaatatattatgttgtgtttttgagtgttgtttttggggttgtgtgttttttattattttttttttgggttttgagtttttgtagattgagtagggttttgtatttgattttggttgattggaggttttgaggtaagttatttaattttttagaattgtttttttagtttgtaatagagtggttagaatggagggttttttgggtttttttttatttagtgaaaagttttttgtgggtttttttgagttttaggatagtttgtgagtgaagttgttatttttgtatttgggagtgtttttgtttgttttttattattttgtagttatagattttttatttgttttttggtagagtaggaagatgtagtaggaggatggggtttttttgttttgtttttataatttatgtttggtaggtagtaggtgttaaattagtattagtgtggatttag

SEQ ID NO: 227 - DNA, 2257 bp, Artificial Sequence
  chemically treated genomic DNA (Homo sapiens)
ttggatttatgttgatgttggtttggtatttgttgtttgttaggtgtgggttgtgagagtaaaatagagaagttttatttttttgttgtatttttttgttttgttgagagataggtaaggagtttgtggttgtagggtggtggagagtagataaggatatttttagatgtagagatggtagttttatttatgggttgttttggggtttaggaggatttatagaaagttttttattgaatggaagggggtttaaggggttttttgttttgattattttgttgtaagttgaggaagtagttttgggaggttgggtgatttgttttaaggtttttggttagttagagttagatgtagaattttgtttagtttgtaaaggtttagggtttagagggaggatggtggaaggtatatggttttagggatggtgtttagaggtatagtgtggtgtgttttagggttttagggatagaggggtagttttgttggggagtttttttggggtttttatggaaattattggaggaagaggaaattgagggttagtggtgaggtgtttgggttgttgagtttagttttttttgggtatagtttggagtttgtagggaagtgggagaatttaggtaggtgttggaggattagttaggtagtgtagaattagagggtggggagattggttgggtagtataggatttgggggttgaagggatggtatggttgggtagtgtagaattagagggtggggagattggttgggtagtataggatttgggggttgaggggatggtatggttgggtagtgtagaattagatggttgggggattagttaggtagtgtgggattaagagggttagggaatggagttggaattgaagaataggttagtttagttatggggtttaggagagggttgagttagatagagttatatatttgggtgtaggtattaagagaaggaggtgtaggtgtatgaggtttagttttttgtagatgagatttagggggatgtgagggttgggtagaattgggaaagttgagtaggagatgttttgtttttatgtttggttgaaatatgaaaatatgaagggttagtgggaaagggattttatagatatgttgggtttgtagtgttttttgttttgtttaggtaagttttaggttgaaaaagtgtttagaattgggtgaggtgggaggagggaaggggagagggagtttgtttgtatttttttttttaagggagaagttgtttttggttgggtaggagtagggttttttttgttgtgtgttgtttattttttgtgttttttttttttttgagttattttggtgtaagagaaatagtgagggatgtggggtgtgaggtgtttttaggtttttgggttggtttgtagtgttttgttttgtgtaaggggttgatgatgaatgttggttggagtagtggtttgggggtgtggttgattttatttaggtagggtataggtggattttggtgttgattgtttggtgggagtgtgtggatagtatgagatttgttggttttggggaatatgttttgggtatttgtgtgggtagtattgtttattattttttgatggtttttttgggggtttttgtttttgtgtatggagttgtttttattgagtgtattagtttataggttttttatttttaaggggttttttatttttaaggggttaggttgattttgttgagttagggtttatatagtttggttgtaggggttttttatttatttttgggtttgatgtttttatttgggttgttttttgtttttttttatggttatgtagatattttaggtttattggatgttgtaaaatgttgtttaggttttatttggttgagggttgttttttttgtaagttttttttttggttttgggtgttggtattagtttatttaggtttatttaggtttttttttttttttaatataggttttgttggtatatatttaggggttagattatgttagtaggagttggatgaggttatagtgagggagttggtagtaggtggtttttgagaatgtgggagagaatataggagagagatggggtggggggggttatagttttgttggggtagttgtgttgttgttaggatgtgtttgaagtattggtttttgagtttatatgtttttgtttaaatttttgtttggaaatttgggaggggattaaagttttgttttttaaggtttttgttggagatatagttttatggtttaggttggtttggt

SEQ ID NO: 228 - DNA, 2352 bp, Artificial Sequence
  chemically treated genomic DNA (Homo sapiens)
tgtttttgttgtggttgatgttttagtttttgtttttgtttttatagggtttgttttgtgtatttgtttttattttgttttgttttttatggaggaatattagtgattgatttgggatttagttttaatttagggtgattttgtttttagatttttaattatatttgtaaagttttattattagggaaggttgtattttgaggttttgggtggatatgaattttgggggtaggatattgtttagtttagtgttgggtgttgttgtgggttaggttttttgatttttgtaagtttatgatggttatagagttttaaggaggaggttttttggaggaggtggtttagtttattagagaattagtatgttttttttttgggttttgggattagtatttttaatgataagtttttttggattatgttgatttgggttgagatttgttgtttgttgtgtgttttgggtggaggttagataggttgtgtatttttaagttttgatatgttttttttttaaagggtggaggttttatagggtgagtgtaggttggggatgggttgtggggttgttgggaggggattagtgggggtttgtagtgtttttgggagggtttggggttgggggtaattgagatttgttttggtgggtgagtggagaagtatttggggggttttttttagtgttggagagaaatgggtgatgaagtttgggaaaggtgtggggggtttgaagtgtgtattatggtgagaaggttgtgtgtggttggattttagtttttttgtgtttgtgaaaggttgagttgtgttggttgggggagggttggaggttgttgggggttgggggatgaagagttgggggtagtttagggtagtgtattttttgtggaggtaggaatggtaggtggtgtgatttttattaggatttttgttattggaattgtgggtttttgttgggttggaggtgtttgagagatttttgtggaatggtgtgtgaatttgtggttgtggtggtgggtttggatggagatggatgttggatgggttgttttttgagtttggtttttgtggtggggttggttttttgtttttgtatttggtagatttgatgtggagtttgagggtggttgttggtttggggtggggaaggggttttttagattgggggttttatttgttgggtttggggagtttatttggttttttttgattggtttggagttgtaggtgaggttattttaggaagttgttgtatttgagggagtttgggttgttttgggggatgttggggtttgatttttggggttgggggttgtatgggtgggttggggtttgtttgggttggggtttgtggttgtgtggggtttggattggtgtttgtttggtttgggggtttttagttgtatgtagtttgggttgaggttgggggtttgtggttgtgtggggtttgggttggggtttgtttggtttgggggtttttagttgtatgtagtttgggttgaggtttgtagttgtgtggggtttggtttttatggtttttgtgtttggattttgttttttaattattttttttgtatgtttttttggaaaaggatatggggtttagggtggtggatgtggatattttttgaaatttattagttttggtttgtgatgtttggatggaggggttatagttatgttggtttttagtttttttttagatattttagtttttggaggtagggtttttttgtgaggtgtattatttttgagtgttttatatgtttgtttttgggtatttttttgggtggtggtgtggtgtggttttgtgtttttatttaaattttatatggaaatggagtttgtagtgtgatggtggggtttggtggggagtgattgggtagtaggggtggattttttgtgaatggtttggttttgttttttttggtgttgtttttgagattgtgagtggttatttaattgtgttttgtatttgttttgttttttttgtttttgtttatgttatgtgagatatttgtttttgttttgttttttattatggttggaagttttttggggtttttttagaagtagaaatatttgtgttttttatatagtttataaagtgtgagttaattaaatttttttttttataaattatttagttttagggttttttttgtttgtttgtttgtttgttttggtggaggtgggggtggatagtgtttttttttgttgtttaggagggagtgtagtggggtgattttagtttaatgtattttttgtttttgggttgaagtgatttttttgttttagttttttgagtagttgggattatagttatgtgttattatgtttggttaatttttatatttt

SEQ ID NO: 229 - DNA, 2352 bp, Artificial Sequence
  chemically treated genomic DNA (Homo sapiens)
aaagtataaaaattagttaggtatggtggtatataattgtaattttagttatttaggaggttgaggtaggagaattattttaatttaggagtagagggtgtattgagttgagattgttttattgtatttttttttgggtgatagagagagatgttgtttatttttgtttttattaaaataaataaataaataaataaaaaaaattttgagattgggtaatttatagagaaaagagtttgattggtttatgttttgtaggttatatggaaagtataggtgtttttgtttttggagaggttttaggaagtttttaattgtggtggaaggtgaagtgggagtaggtgttttatatggtgtgagtgggaatgagaaagatagagtaggtgtgggatatagttaaatggttatttataattttgaggatagtattaggagggatggggttaagttatttatgagaaatttgtttttgttatttagttattttttattaggttttattgttatattgtagattttatttttatgtgaggtttgggtggggatgtagagttgtattatattattatttaggaggatgtttaggagtaggtgtgtggggtgtttagggatgatatgttttatggggggattttgtttttaggggttagggtgtttgggaagaggttgggagttggtgtggttgtggtttttttatttaggtattatagattagggttggtgggttttagggggtgtttatatttattattttgaattttatgtttttttttagggaaatgtgtagaggaaatggttggagagtgaagtttaggtataggggttatgagagttggattttatgtagttgtagattttgatttgaattgtatgtggttgaggatttttaagttaggtagattttgatttagattttatgtggttgtggatttttgattttgatttaaattgtatgtggttgaggatttttaagttaggtagatgttaatttagattttatgtggttgtggattttaatttagatagattttgatttatttgtgtagtttttagttttagaagttaaattttagtgttttttagggtggtttgggtttttttagatatagtagttttttgaggtggttttatttgtaattttagattaattagagaaggttaaatgggttttttaagtttagtaggtgggatttttgatttagagagttttttttttgttttaggttaatagttatttttgggttttgtattaggtttgttaaatgtaggggtgaggggttgattttgttatgggaattaaatttaggaaatagtttatttagtgtttatttttatttggatttgttgttgtggttgtaggtttatgtgttgttttgtggagattttttaggtgtttttggtttggtagaaatttgtggttttgatggtagaggttttggtgggaattgtattgtttgttgtttttgtttttgtggaggatgtgttgttttaaattgtttttggttttttattttttaatttttggtagtttttgatttttttttggttggtgtagtttagttttttgtagatgtgggggagttggaatttgattatgtgtagtttttttattgtggtgtatgttttgggttttttatgttttttttaggttttattatttatttttttttagtgttgaaggaaattttttagatgtttttttatttatttattgaagtaggttttggttgtttttagttttgggtttttttgagaatattgtaagtttttattggtttttttttggtaattttatggtttatttttaatttgtatttattttgtggggtttttattttttggaggaaggatgtgttaaagtttggaggtgtgtggtttgtttaatttttgtttaaggtgtgtggtaggtgataggttttagtttggattagtgtggtttaaaaggatttattgttaaaagtgttggttttagaatttaaggggaagatatgttggttttttgatgagttgggttgttttttttaggaagttttttttttggagttttgtagttattgtgggtttgtaagagttaaagggtttggtttatagtggtgtttggtattgagttggatagtgttttgtttttaaaatttatgtttgtttagaattttagaatgtaattttttttggtagtagggttttgtagatgtaattaaggatttggggatgaggttattttggattgaggttgagttttaagttagttattggtgtttttttatgaagagtagagtagaatagagatagatgtatagagtaggttttgtgaggatagaggtagggattggagtgttggttgtagtaggggtg

SEQ ID NO: 230 - DNA, 2470 bp, Artificial Sequence
  chemically treated genomic DNA (Homo sapiens)
aaaattaattgttattttaaaatgtattgttttgatattttgttgttgaggtaggtggtgatatgtagaaattaattttttttttaaaatgaaaaaataatgtatttattaatatgttttttttaaaatttggggaaaatttttaaattggagaaaaaaatttaatattagtatttattatataaagtattaaaaatattttttagtagttttgtttaagtattttaggttagtggtagtatgttagttaaaatgtaatttaaaatgaatgaataatagttagttggtagatattgtatgtaatataatatggaaatatattggaagtattttaaaatttaatatttgaatttgtgaatgtttaaattaagtattttaaattaggtgtttatttttgaaataatattttaaaatatgtgttggtggtaagattgttagttatttgtaggaaatttttttaatggtttaaaatttttaggttttagaaggggtgattgattaggttaaatttatattttttggttttgtagttgttagtttaggtagtgaatttaaaatattgggggtggatgagtagtttgaagtttagattaaggagtgaaaaaggttgatgtttagaagtgttggtttttttttatttgtgtatttgagaggttatggtgtagtaaagtttggttttattagtgggtttggatgtttgtgattaaagttttttaagaaaagttgatattgtggttgggagtgtttggaagtttagtaggatatgtttttattgtagggaggagggtgtttgtggtggttttggtgtggagtttttttttttttttttgtaggattttgtatttggatggggataggttttgttagttaaggtggtgggagatgtgtaggttataaggaggaaatgggatagagtgtgatagagaggtggtggtggtttagggttgggttgagttttttttgtggggtagtgagagggaaaggggtttttttggttgtagttttttttattttgagaggtagttttaattttttttttagtgtatgatgttgtatgggttgtgtgagattttgaaattttgttagtttttgtgttgttttaggtttgttttagtgttttgtgttggttgttaatttttgttttttttagatagttgtttaagtttatttattttgtgggttgattagtgtttattttagattgaggttgaggtgtttggtttggttgtggttttatagtaggtttttaggttttagttattttgttgttaagttttttaatatggatttttttgtttgttttgtggtgttatagggtttttaggatattgattttgttggtttggtttggaggtggtggtgaagtagggagtgatttaggttgtgttgttttgtgtggtttaagttattgttattttttttttttttgttttgtttagttttttttttttttttttttttttgtgtgtttttttttttttttttttttttgttgttggtgtgttaaggtgatgatggtggtagttggatttgttatattttgtttatttgtttgttttggttttgagtgtatgtttgtagtatttagttgggttgtaggggggtgttggtaaattgttgtttgagattgagaagtgtggtgggtggagttatgttatgtggtttgtgagtgggaggaagggtagttgtgttggaggggttttttgggaaatgtttttttagtattgttttttgtttatattgtggatggtgtgtatgtgtagtgtgtggattttggtttttgtttttttttggtagttttataggttgtgttgtggaggataatgaaagaggttttaagggaattggataggaaggattttgtgtagggtgtgttttttatttttatggtaatttgatattgaaaagagtgtttgtatgtttgtggtggattgagtgtttatttggttgtgttgtttatttgaaatgtagtttgtggagtgaagagttggtaatttggaagtttatttttttttttttttggtgggtatttttttagatgttagggggagagtttttttgtttgattttttgagtttaggggtttttttatgttttaattttatattataaaattaaatttgggttaggtgtgtggtggtttatgttggtaattttagtgttttgggaggttgaggttggtggattgtttgagtttagtagtttgagattagtttgagtgatgtattaagattttgtttttataaaaaataaaattaattggttgtggtggtgtgtatttgtggttttagttttttgggaagatgaggtgggagaattgtttgaatttgggaggtggaggttgtagtgagttgagattgttttattgtattttagtttgggtgatagagtgagattttgttttaaataataataaaaattttattattatttatttaaaaggtttttgtgttgtggttagatagtgatg

SEQ ID NO: 231 - DNA, 2470 bp, Artificial Sequence
  chemically treated genomic DNA (Homo sapiens)
tgttattatttaattataatgtggaggttttttaagtaaataatgataaagtttttgttgttgtttgagatagggttttgttttgttgtttaggttggagtgtagtggaatgattttggtttattgtaatttttgttttttgggtttaagtgatttttttattttatttttttgaggagttgggattgtaggtgtgtgttattatggttggttaattttattttttgtagaaatgagattttaatatgttgtttaagttggttttgaattgttgagtttaagtgatttgttagttttggttttttaaagtgttgggattattggtgtgagttattgtgtatttggtttaaatttaattttgtgatgtggggttaagatatgggaaagtttttaggtttggggagttaggtgggaaagttttttttttggtatttaaaaaaatgtttattagaaaggaggaaaggtgggtttttaaattgttgattttttattttataggttgtattttaggtgggtagtgtagttaggtgaatatttaatttattgtaaatatgtggatattttttttaatattagattattataaagataaggagtatattttgtgtaaaattttttttgtttagtttttttaaagttttttttattgttttttgtgatgtagtttgtaaaattgttaaaggagggtagaggttaaagtttatgtgttgtgtatgtgtattatttgtagtgtgggtgaagggtggtgttggaaggatgttttttagaaggtttttttagtgtagttgtttttttttttgtttataggttgtgtgatgtgattttatttattatgttttttggttttaaatagtagtttgttagtgtttttttgtggtttaattgggtattatgaatatgtatttagggttagagtgagtgagtaagtagaatgtggtgagtttggttgttgttgttgttattttagtgtgttgatagtgagggaagggaggaggagggagatgtgtagggaggggaggggagggaggaggttagataaggtgggggaagggggagtagtggtggtttaagttgtgtggagtagtgtaatttgggttgttttttgttttgttgttgtttttggattgagttagtggagttagtgttttagagattttgtaatattataaagtggatgaaggagtttatgttggggaatttggtagtggagtgattgggatttgggaatttattgtggggttgtggttggattgagtgttttgattttggtttgaggtaaatattggttgatttgtggggtggatgggtttgggtagttgtttgggagagatgagggttagtggttggtgtagagtgttggagtgggtttagggtgatgtgagggttgataaagttttggaattttgtgtggtttgtgtgatgttgtgtgttgggaggaaagttggagttattttttgaagtgggggaggttgtggttgggagggttttttttttttttgttgttttgtgagggaggtttggtttggttttgggttgttgttgtttttttgttgtattttgttttattttttttttgtggtttatgtgttttttgttgttttagttggtgaagtttgtttttgtttgggtgtagggttttatgggggggggggaaggggttttatgttagaattgttatagatatttttttttttgtagtggaaatgtgttttgttgagtttttgggtgtttttgattgtggtgttggttttttttgggagattttggttgtgagtgtttaagtttgttagtgaaattaaattttattatgttgtgattttttgagtgtgtgaatggggaagagttggtgtttttaagtattagttttttttattttttgatttgaattttaaattatttatttatttttagtgttttaaatttgttatttgggttgataattatggggttgggagatataaatttagtttaattagttgttttttttgagatttaggaattttgaattattaaaaagattttttatagatggttggtggttttgttattaatatgtattttgaagtattgttttaaaagtagatgtttgatttagagtatttgatttagatatttatggatttaaatgttgaattttgaaatatttttaatatatttttgtattgtattatatatagtgtttattagttgattgttgtttatttattttggattatattttggttaatatgttattattgatttaagatatttaagtaaaattgttgaaaaatgtttttaatgttttgtgtagtagatgttgatgttaaatttttttttttgatttgggaattttttttgaattttgggaaaagtatattaataaatgtattatttttttgttttaaaagaaaaattaatttttatatattattatttattttagtagtagaatattagggtagtatattttaaaataatggttggtttt

SEQ ID NO: 232 - DNA, 2305 bp, Artificial Sequence
  chemically treated genomic DNA (Homo sapiens)
ttgagaaattgttatagttataagaggtatataaggagatattataattaaatgtaatgtggtattttggatggaattttggaatagaaaaagggtattaggtaaaattgaaggaaatttgaataaaatgtgaattttagttaataatagtgtaaaatattggtttattaattgtaataaatgtattatattagtatgagatgttaataataggggaaattggatgttgggtatatggtattattttaatttaaataaattatattaagaaaataatatttatttttaaaggtgtagtgaataaaataatggttatttatatatttaatatttggtttaataatggttaatatagttaaagtttttttttattgttttttttttattagatatgattgttttttttaatttgatttttatttttttgtattttttgatttttttaattatatatgtatgtataattaagtaatatatagtattgttttataagttttagagttgaatgtatatgaattgttatattatttatttttttatatttttttttttttgttttattatatttttgagtttagtttttttttattggtgtataatattatattttaatattttataaggtatttattttgttattgatggatgtttttaattttttgtttttatttatagtgttgttatgtatatttttgtttatttattaaagtttttataagatatataggtaggagtagagtgttggggtttagtaattgaaaatttttattagattttgttatattgtttttttaaagaggttttaatatttgtgtatttattagtaggtgtgtatgtttagatgtgtggaggagaaattatttaaagatatataaattagataatatatttgttttatttttgtttgatttttgtatttaagtaattatttttgtaaataaataaataaataattattaatagtattttttgtattgttagttgtagttttttttgtggagatgtggatataaggtagtttttggtgaaggtggtgatgtaaaggatggtgtaagtatgtttgggatgatggtgtttttttgattgtttttgaaggtttttttttgggttgtttgatatgatgtaagtgttagtttgtgttggttggttgttttttttttgtaagaggggaaaatatttttatagattttttgtgtttttagagatgatttttttttttagaaagaagttgtttatggttggtgttttttttaggtagtgttgtgggtagtttataggtttttgtaaggtgtgtgttgtggttttgtttttttttttttggttggaattgttattttttaggtagggtttatgtgtggtttttgggtgttaggtgtttgatagatttgaattgtgattttgtggttttagaggttgtttattgggattgtggggagattttttaatttgtttgaggtttattggtatgggtgggttaaattatgttttgttagatggggagtagtgtgtgttgggttgggtttgggttgtgggttgagaattggattgtgatgttgtggttttgtggggggatatttgtgagaaagatgagattgagttgtttggggtgaggtgatttgagttaatttttaaaagattttgttttatgtttttgtggttgtatttttggtattgtgggtggttttttttatataggttgtgtgggggttgtgtggtttgatgtttttttaattttttttagtgtggtttttttattttaaattttgtgatgatgttgggtgaggatttaaggggtagtaggaatgggtttaaagttaggtgttggttttaattttttgtgaagtttataggtgtgaaaatttgggtttttggttggagagtgggttttggagttgttttgggtgatgaatttttattgtttttagttaatgtataagatgatttttgattgtttttaaaattttgattttatatggtgattggatgaagggaaagtgttttgaggttgtaatattaatatttgtattaagaggagatattgttttgtgaattttagggtagtatgttttgagtgaagggaaatatttagttatagtttattattttgtttagtttgtggatgttaatagagttgagtaaattgtaggttgttttttatggtggattttagttgttatgattttaatatttttataaattgtaaagtattgttttgaaaagtgtttttagttttaagtgtatggggtttatgtttaaaatggattttaaatttagaaagatggatttagtggaggattatgggttt

SEQ ID NO: 233 - DNA, 2305 bp, Artificial Sequence
  chemically treated genomic DNA (Homo sapiens)
gagtttataattttttattagatttatttttttgagtttggaatttattttaagtatggattttatatatttaaaattgaaggtattttttaaaatgatgttttatagtttgtaagagtattaaaattatggtaattaggatttattataaagagtaatttgtagtttgtttgattttgttgatgtttataaattagataaaatgatgaattatggttaaatgtttttttttatttaaagtatgttgttttagaatttgtaaaatagtatttttttttggtgtaaatattggtgttgtaattttaaaatattttttttttgtttgattattatgtggggttaaaattttaaaaatagttggaaattgttttatgtattaattaagggtagtgagggtttattatttaggatgattttgggatttattttttgattgagagtttgggtttttatatttgtaggttttatagaagattaaagttgatgtttgattttaaatttatttttattattttttaagtttttatttaatattattgtaagatttggaataaaaaagttatattgaaaggagttagaaaggtattaggttatgtggtttttatatagtttatgtgagaggggttatttatagtattggagatgtagttatgggaatataaaatgaagttttttaaagattaatttgagttgttttattttaagtgatttagttttgttttttttgtaaatgtttttttgtagggttgtaatattgtagtttggtttttagtttatggtttagatttgatttggtgtatgttgttttttgtttggtagaatatggtttaatttgtttatgttaatggattttaaataggttagagagtttttttatggttttaatgaatgatttttgaggttataaggttgtggtttaagtttgttgaatatttagtgtttgggagttatgtgtaggttttatttggaagatggtggttttggttgaaaggaaagaggtggggttgtggtgtgtgttttataagggtttgtgggttgtttatggtgttgtttgagggaaatgttaattgtaagtgatttttttttagggaagaagattgtttttgagaatatagaaagtttgtgaggatattttttttttttgtgaaagaaaggtaattggttaatataagttgatatttgtattgtgttagatagtttggaaaggggtttttaagggtgattaagaggatgttgttgttttgagtgtgtttatgttattttttgtgttattgtttttgttggaagttgttttgtatttgtgtttttgtagggaaaattgtggttggtggtgtgggaagtgttattagtagttgtttatttgtttgtttgtagaaataattgtttgggtatgaaggttaaatgagaatgaagtaagtatattatttagtttgtatgtttttaaatagttttttttttatatgtttaaatatatgtatttgttagtaggtgtgtaaatgttaaaatttttttgggaaagtaatgtggtaaaatttagtaaaagtttttaattattaaattttagtattttgtttttatttatatgttttgtagaaattttggtaagtgaataaggatgtatgtaatagtgttgtgggtagaagtaaaaaattagaaatgtttattaataatagaataaatattttatgggatgttaggatgtagtattatatgttaataaaagaagattgaatttagaaatgtgatgaggtaaaaagagaaagatgtagaaaaataaatagtatgataatttatatatatttaattttaaaatttgtaaaataatgttatatattgtttagttatgtatatatatgtagttaaagaagttaagaaatataagagaatgaaaattaagttgagaaaagtagttatatttggtaaggaggggataataaagggaggttttaattgtattgattattattaaattgggtgttaaatatatgggtggttattgttttatttattatatttttaaaaatagatattatttttttaatgtagtttatttaaattgagataatgttatatatttagtatttagttttttttattattaatattttatgttaatatggtatatttgttgtaattaatgaattaatattttatattgttattaattaaggtttatattttatttagattttttttggttttatttaatattttttttttgttttaggattttatttagaatattatattatatttagttatgatgtttttttatatgttttttgtggttgtggtagttttttaa

SEQ ID NO: 234 - DNA, 2234 bp, Artificial Sequence
  chemically treated genomic DNA (Homo sapiens)
ttatttgttattttgtttgttttgtttgtatggtaggttagtttttgtttttagagtggagatttgaagtatttaaaaagtttatttatttttttttttttttttttagttagagaagagtgattgttttattttttgtttttgtttttatatttttggatatttagggagtttggtggtggggaggtgtgtttttaggtgttttgtttttagtttttttgtggggtttgtattagatttggaaaaaataggttttagggtggggaggggtaggatttgaggtggttgtggttgggagtttgagttagtgtggattgtgttaatgtttttgtagtagtttggtttgttattttttgagagttatatagtgggtaggagttatttttatttgagtttttttttttttttattttgttataagatagaattgtattatatatttttaaaatgagtaaaatggtattttagttttttgtttttatagattttttgaattttaggaaagattattttggtttttttttattaataatgaaaattagggggtaataaaatgtttttaatgtgagtatggtaggaatgaggagtggtgaggggtgaagggtgaggttgtagggattataggtgttttttggggttggaatagtttagaattttggaaagtgaggtagttattgggagggttttggtttttaatttatatagttagtgtttgtttagttttgatagtttagagggttttagagaaggttgttttttttatggtgggatgtttgtgggtgagtagaggaatttagtaaattttaggtgttggttaagtttttagttaagttatagttgtttttttgtaagaggttttatggtgtttgagaaattagtggtgaatatggtatttgggttgtgggttttgttttgtatttgttttgtttgaggattttggttgtagggagggatgttttgggtatggatgaaggtttttttgagtagggattttgagagagtggggtggttaggttgttttgtttttattttttttttttgaaaatggatttgtattagatgttaggttttgtatttggagtgttaagtaaagttggttagaagaggggagatagaagagatatttgattaggattttaagtgtttggttttttggggttgaggtgaaagatttgtttgttttagtgtttttagagttttttgtataatgagaggtgatttgtgttgggtgggggtgtttattattagtgaagtagtattgttttttttttatggtagttttttagatattgagtgttattgtatagtttgggaagggagtgggggaagtttttgttaattataatataaattttagaatttataaaagaatagattgataaatttgtataaaaatttttgtatgtgataaaatattattagtagagttaaaagaaaaataaattagagaagatgtttgtgatgtagattatagatagtgggttaatatttttgttatataaaaagtttttttaaagtgataagggaaaagaaattaagtagaaaagtggagagtatatagtatattgaaaaggaaatgttgatgaaaatatgtttaatttttatttaaaatgagattaatgtaaattagaattagagtgaatttttgtttttttgttgtggtattggtaggaatttttgtgtttgaattgtgtattgtgtgggtgtagttgtggggaagtaggtattgtgtagtggtttagggtgaattattggttttatggaggtagggtggtagtattttttaaaattgtaaatgtatatgttttgggattattttttgggggttttgaggtttatagggtgtgtgtttttatgtgggagatggtatgtgtgtatgttgttgatggtagtgtggtgtgtagtagtagaaagttggaaatgagttgggtgtttattggagggtaggtgaagtggaatattttgtagttgtagaaaataagattgagagatggggaaatgtgaaggaagagaagatattttgtgttattttaggtgtgtatatagatttattggaaggataaatgtaagattattaatggttgttggtggtggggaagtttttttttatagattgttttgtgttatttgatgagtaaattgtatgtgtgttatttgtttaaaaagtgtaaaatagaaatgggagttggggattgagggagaggttttatgttgattatagttttgggattgag

SEQ ID NO: 235 - DNA, 2234 bp, Artificial Sequence
  chemically treated genomic DNA (Homo sapiens)
tttggttttaaaattgtaattaatatagggttttttttttagtttttaatttttatttttgttttatattttttgaataggtagtatgtatatagtttatttattgaatagtatagggtagtttgtgaaaaaaggtttttttattattaatagttattagtagttttatatttatttttttagtgagtttgtgtgtatatttaaggtggtataggatgttttttttttttttatgtttttttattttttaattttgttttttatagttgtaggatattttattttatttgttttttgatgggtatttagtttatttttaattttttattattgtatattatgttgttattaataatgtgtatatgtgttattttttatatggggatatgtattttgtgagttttagaatttttagagggtggttttagggtgtgtgtatttgtagttttgagaaatattgttattttgtttttatggggttgataatttattttgagttgttgtgtaatgtttgtttttttatggttgtgtttatataatgtatgatttaaatgtagagatttttgttaatattatagtaggaaaatagaagtttattttagttttaatttgtattgattttattttgagtgaggattgagtatgtttttattagtattttttttttggtgtattgtatgttttttatttttttatttgatttttttttttttgttattttagagagattttttatatagtagggatattagtttgttgtttgtgatttgtattgtaaatattttttttggtttattttttttttgattttgttaatggtgttttgttgtatgtagaggtttttatataaatttattaatttatttttttatgggttttggggtttgtgttatggttagtaaggattttttttattttttttttaggttgtgtagtgatatttggtgtttaagaaattgttatgggaaggggatagtgttattttattgatggtggatatttttatttgatataaattattttttgttatatagggagttttaagagtattgaggtagatggattttttattttgattttaaggagttgggtatttggagttttggttaggtgttttttttgtttttttttttttagttagttttgtttggtgttttagatataaaatttgatatttagtgtaagtttatttttaggaggaaaaagtgaagatagagtaatttggttattttgtttttttagagtttttgtttaggagggtttttatttatatttggaatatttttttttgtagttaaaatttttaggtagaataagtgtagaatggggtttatggtttgaatattatatttattattgattttttagatattatgaagttttttgtaagaaagtagttgtgatttggttgaaagtttgattagtatttggagtttgttggatttttttgtttatttgtaaatattttgttatgagaaggatagttttttttggggttttttgggttgttaaggttgagtagatgttggttgtgtgggttgaggattaggatttttttaatagttgttttattttttagagttttgagttattttagttttaagaaatatttgtggtttttgtagttttattttttattttttattgttttttatttttgttatgtttatgttaagaatattttattgttttttggtttttattattaatgaaaagggattagaatgattttttttaaagtttagagagtttataaagataagaagttgaaatgttattttatttgttttggagatgtgtgatataattttgttttgtggtaaaatgaaaaaagagaaaaatttggatagagatgatttttatttgttgtgtggtttttagagggtaatagattaggttattgtaaaaatattagtatagtttatattagtttaaatttttagttatgattattttaagttttgtttttttttattttggggtttattttttttaagtttggtgtagattttgtaagggaattgagagtagggtgtttgggaatatatttttttgttattaggttttttgaatgtttggaggtataaagataagggtaggagatggggtagttatttttttttagttgggaagaaaaggaagagaatgagtgggttttttaaatgttttgagtttttattttggaagtagggattggtttgttatgtagataaggtagataaggtagtaagtgg

SEQ ID NO: 236 - DNA, 2317 bp, Artificial Sequence
  chemically treated genomic DNA (Homo sapiens)
ttatttggttttttgttttggggtttttaaggagtaagggaaagttgtggtttttggtttgtgtttggttggtggttttatatttttttatttgaggttgattttttatttgaggttgatttgttatttgaggtgggaaggggtatttggagtttttagttgtagggtgagagatatttagtggttttattttttagtttttagagttataggttaggagtggagggttaaggttggtgaaaaaatttggttatgtggatgggttaaagattaggggttgttgtgaaggtgaggatagaaaagtgttgtagaggtttttagattatggttttgtttttgttagagagttttaggggttttagtggtttttttagtgttgtgtatatatgaggaaaggttagagaatgagagggatatagtatttttttattttttaagtttgtatggggagaagtggttgtgagttttagtattagggaaatgtagtgttggggtttgggtaggattgattgttttagtttttattttagttgtaattttttagttgaatagggtttgttttggtgggttagggtttttgtttttgttgaagaattttggtttaggaaagatggagaggttgggggttgaggagagaggaaaaaatggtaggggaggattggaggtgattgagtgttgagtttttatatttttattattgttgttgttgttgttattattattattattattattattattattattattattattgaagtattttatgtttagagttaagataagattataaatataatatatagaaaattaataaaatagaattttgtttttttttgaggtttttttttttatttttaggtagtatgtgttttttttagtggttttggggagggggtgggagagatgataggtttgggattagggagtttttaaggtttttgttgaggggatagtgaatttattattgaattgtgtatgggggatatggataaaatgagatgtgatagggataagagtattttgttttgtttttaggaaatattaagtgagtttgttttttagtttttattaggaagtttgattaggttgaggtgagttttttgggaaggaagggtgtgtgggatgttgggtgggtttgagtagtgaggttttagagtatttgttgggagttgtgtgggtgggggtgtttaggagagtgttgggttttgtttgtttgtgttggagagtaggttttttggtttttttatttgagagtttttttttttgggtttttttgatgtttttggttttttataggtttttttttttgtgttttttttttttttttagtatttttatttggtttgttttttttttttttttttggtattgagttgagatgtgttgagtagtttgtttttttttttttattttatgtgttggttttggaattatattttgatttgtttttttgttaggtatagggtgtgtgtgattttgatgtgttgttgttgtgttaggtagtgattgtagtgaaattttttttttagttttagtgtttggtaatgtgtgtatgtttggtggttttgttggttgttgggtttaaaggaggaatttgttatgtagagtggagatgttgaggtttgtggttattgggtttaggatttttttttttagttgatttttgaatatagattttagttagtattgggatgttttttattttgttggttttttttttttgttttgtatttttttagtgttttttttagatttttttttagttttttaggtttgtgttgtttgtttagattttagatgggggaggggaggagtagtttgaatttttatttgagtttggggggaggggttggttaggtgtgtttttttttagttgtattttgtttttttttttttttttatttattttgtttttattttttgttatttttttaatttaatgataaatttaggttgttaatttgtaatgatgtagattgatttatagtttatattaatggttttttatttttgagtttggttaatggatattagttgggatttaaggttaataaataatttaatttgagattttgtgtttgttttttttttttttgttttgtttgtttttttttttttttttttttttatttttttttttttttttgattattattttttttttggtgttttattttgttttagttttttatttatagggaaatatagttttagatagatttaattttttttttttagtgttattttttatttttttgtatgatgtattttgtttttaatggagttgtttttggttggggaattttattagggt

SEQ ID NO: 237 - DNA, 2317 bp, Artificial Sequence
  chemically treated genomic DNA (Homo sapiens)
gttttggtagggttttttaattaaagatggttttattaaaaatggagtgtgttatgtaagggggtagggggtgatgttgaagagaaagagttgagtttgtttgggattgtgtttttttgtgggtggggagttggggtaagatgaggtattaggaaaggggtggtagttagaggagggaggaggaataaggggaaggaagagagagggagtaggtggagtgagagagggagaaataggtgtggggttttaggttggattatttgttggttttaagttttaattgatgtttattagttggatttgaaagtgaggagttgttaatgtggattatggattgatttatgttattatggattaatggtttggatttattattgggttggggggatgatggggggtgggaataagatggatggaaagggagggaaagataagatgtaattaggaagagatatatttgattagtttttttttttaggtttaggtgggagtttaaattgtttttttttttttttatttagagtttagatagatggtataggtttaggagattaggagggaatttggagggggtgttggaggagtgtgaaatgggggaagggagttggtagaatagagggtattttggtattggttggagtttgtgtttgagggttgattaggggagggggttttgggtttggtgattgtaggttttagtatttttattttgtgtaataggttttttttttgggtttagtggttggtgaggttgttagatatatatatgttattagatgttggagttggagaaggagttttattataattgttatttgatgtggtggtggtgtattgagattgtgtatgttttgtgtttgatggagaggtagattaagatatggttttagaattgatgtatgaagtggaaaaaggagagtaaattgtttagtgtgttttagtttagtgttgaggaggaggaagaaaaataggttgagtgaaggtgttggaaagggagggaggatgtgaggggaaaggtttgtggggagttgagggtgttagagagatttgggaaggaaggtttttgggtgggggagttaggagatttgttttttggtgtagataggtggggtttagtgtttttttggatgtttttgtttgtatagtttttggtgggtgttttgaggttttattatttgagtttatttagtattttgtgtgttttttttttttgaggaatttgttttagtttgattaggttttttggtgagaattgaggagtggatttatttgatgttttttggaagtagagtaaaatgtttttgtttttgttgtgttttattttgtttatgttttttgtgtatggtttaatggtagatttgttgtttttttagtgggggttttgaagattttttgattttagatttgttgttttttttattttttttttaaagttattggaaggagtatatattatttagaagtaagaagaggagttttagaagaaaataaagttttattttattaattttttatgtgttgtgtttgtagttttgttttagttttggatgtgaaatattttgatgatgatgatgatgatgatgatgataataataataataataataataataataataataataaagatgtgaaaatttgatgtttggttatttttaatttttttttgttatttttttttttttttttaatttttagtttttttattttttttgagttagaattttttagtaaaggtgagagttttggtttgttgaagtgagttttgtttgattgggaagttatagttgagataaaggttggagtgattagttttgtttaggttttagtgttgtgtttttttggtgttgaggtttatagttgtttttttttgtgtagatttgggggatggagaggtgttgtgttttttttattttttagtttttttttgtgtatatatagtattaagggagttattgaggtttttaaagttttttggtggagatggagttatagtttgggggtttttgtagtgtttttttgtttttatttttgtagtgatttttggtttttggtttgtttatatggttaggtttttttgttagttttggttttttgtttttggtttgtggttttggagattgaaaaatggggttattgggtattttttattttgtagttgaaggttttaggtgtttttttttattttaagtagtagattagttttaagtaggagattagttttaagtaggggaatgtaaagttattagttaggtataggttgaaggttataatttttttttgttttttggagattttagggtaggaggttaggtga

SEQ ID NO: 238 - DNA, 2553 bp, Artificial Sequence
  chemically treated genomic DNA (Homo sapiens)
ttggttatttttgtttttttttagatttttagagtttttagtgtagttatagaggatgttgttggttttagttttaagaagatgttgttttttttagagggttaagtaagtgggaatttttttttttatttgttttgggttttaggtagggtttttggtgtaaggtttggggttggaagttgatttatttaggtttaggttttggggtagaattgaaattttttggttattgttggttgtagtttgggagtaggttattgttaaagttgtgggtttttttaggatagtttttttatgaggttggttttttatttgttgtttttttatatttggtggttagggatgtggttttgggtagaatgatgattttttatttttgttattatggaagttattgttgttttttagtttagttagttatttgggttgtagagtattttttttatgttttttgggtgtttttttttttttttgttttagtttggttttgttttattttgtttttagggaggggtattttggagtggggttagggtatggtttttttttgagggagtttttttttggttgtttttagggtagttttgtatagttttagtatttggtgtattttttttgatattttttttagggatagttaggtattttgtgtggggtatttaagagagttaggtttgttagtttttagtttttgttagaatgtaggtttgaggggtgaggggtggggtaggggtagggataggaattttggtgtgttttttatttgtaaaggtttattgaggttttgagttttagttattgagttattaagttagtttgggttaggtttgggtgttttgtttgtaatggaggtagagatggggttttggggtagttttgaggatgttgggtgtatagtgggggttttgttggtaggaattatttatgtttttttttgggttaagttttgtggatgtttagtttggggttgtggggagttggtaggttagtggtagatattggtgggtagatttagtgtttggtagaataggtattaaggaagtggtgattggagggaagttaagtgtatttaaatttttgggtgagttattattgttgggttttttatagttgttgaaagtgagtaatagtgatgaaggtttgtgagtttttgtgtgagtgagtgaatggattagtagtagtttttaggttgtggaagagtgttttttttttgggatggggatatttggttatagtaatttttaattttttatttatttattgtttattgtagaggtatgtgggggttttgttttttgtaggtaggagtgaggggtatttttgtgatgtggtatttttgtgattgaggttatgtgtgattggtgtaagggtaggaagtgagttattggtttgtattaggtgtgggggtttttgtgagggtaggatttaaagttggtttggttttttggttgtagtattttttttttttttgaattaggttagagttttgggatgggaggtgttttgtagattattttttttattaatttttgttttttgttttatttttgtggtgatttggtgaattgttggttttttgttgtgtattgagtggggtagtgattttgatgtggtgttttttgttgtttttgttattgttattatttttggtggtttagtttttgtattttttatttttatggaggaatgtattaggtttttttttttggatgtattttttatttatatgtttttaaattttggtattttttgttttttttttatttttatttttttttttaggtttttagataaaggggaagtggttggatttttttaaagggatagtgttttattagtttattgttgaatttttttttttaattttagttttttagttatagttaattagtattagtagatagtttatgagtgatatttatgtaggttttaggttgtggagagttttttgggtaggaaatagtttttaaggttttttattttatttaggttttagttttttttatttgttttttttttagattgtggttttttggagtttggtttttttgtttttgtgtgattgatatatagtatttaaatagtggtagagtgggatggattttttagtttgttttttgtgtgggtttgtattttgatttagatatgtttttttatagtaggatttaggggggtatatgtgtgtttgtgggtttattggggtatttgtatttggtttattttattttttagagagagggttttgttgtgttatttagttggagtgtagtggtgtaattatagtatattgtagtttttaatttttgggtttaagtgattttttttttttagtttttttagtagttgggagtataggatttattgtattttggttaattttttaataattttttaagagatggggttttattgtgttgtttaggttggttttaaatttttggttttaagtgatttttttatttttgttttttgaagtgttgagattataggtatgagttattatgtttattttagattgatatttttatatttgtttattttggttgggtaggg

SEQ ID NO: 239 - DNA, 2553 bp, Artificial Sequence
  chemically treated genomic DNA (Homo sapiens)
ttttgtttagttaggatgaataaatatagaaatgttagtttgggatgggtatggtggtttatgtttgtaattttagtattttaggaggtgaaggtgggaggattatttgaggttagaggtttgaggttagtttgggtaatatagtaagattttattttttaaaaaattattaaaaaattagttaggatatagtgggttttgtatttttagttattagggaggttggggagggaggattgtttgagtttaggagttgaaggttgtagtgtgttatgattatattattgtattttagttgggtgatatagtaagattttttttttaaaaaataaaataaattaaatgtgggtgttttagtgaatttgtaggtatatatgtgtttttttgggttttgttgtgggggggtatgtttgggttagggtatagatttatatagagaataggttagggggtttgttttgttttgttattgtttgggtgttatgtgttggttatatagggatagaagaattaggttttaaagggttataatttaggagagaggtaggtaggaaagattgggatttggatgagatgagggattttaagggttgttttttatttaggaaattttttatagtttggggtttgtatgggtattatttatgggttgtttgttaatgttaattaattgtaattagggaattggggttgaggaggggagtttagtagtaagttggtgggatattgtttttttaagaggatttagttattttttttttgtttgggagtttaggggaaggggtgggagtaaagggggagtagaaaatgttagggtttggaagtatgtgggtgaggggtgtatttaggaagggaggtttggtgtatttttttatgggggtggggaatgtggaggttgggttattggaggtggtggtggtggtaggggtggtaggagatgttatgttagggttattgttttatttggtgtatagtagggggttggtagtttattggattattgtgggggtggggtggaggatggaagttggtgaggggggtggtttatagggtattttttgttttagggttttaatttaatttgaaagggaaaggagtgttgtagttgggaggttaggttgattttgggttttgtttttgtagaagtttttatgtttggtgtagattaatgatttgttttttgtttttatattgattatatatgattttggttataggggtgttatattataggagtgttttttatttttgtttgtaggaagtagggtttttgtatatttttgtagtgggtggtgggtgggtgggggattaggaattgttgtaattaagtgtttttattttggggagggaatgtttttttataatttggaaattgttattggtttatttatttgtttatgtagaaatttataaatttttattattgttgtttatttttagtagttgtgaaagatttggtggtgatgatttatttgagggtttgagtgtatttggtttttttttggttattatttttttgatgtttgttttattagatattaggtttgtttattagtgtttgttattgatttgttagttttttgtggttttaggttgggtatttataaagtttggtttaggagagagtataagtgatttttgttggtgaggtttttgttgtgtatttagtatttttagaattgttttgagattttgtttttgtttttattgtagatagggtatttaggtttggtttaggttgatttggtggtttagtggttggggtttggggttttagtgaatttttgtggatggagagtatgttggagtttttgtttttgtttttgttttgttttttattttttaggtttgtattttggtaggagttagaggttgatgggtttggtttttttgagtgttttatatagagtgtttgattgtttttaagaaggatgttaagggaggtgtgttaggtattgaggttgtgtagagttgttttggggatagttagagaggaatttttttgggggagagttatgttttggttttattttagggtatttttttttgagagtagggtaggataaagttaggttggggtaggagaagggggaggtatttggagggtatgaaaggggtgttttgtagtttaggtggttggttgggttgggagatagtggtggtttttataatgataggagtggagaattattgttttatttagggttatatttttggttattaggtgtgaagaaatagtaggtggaggattggttttatggggagattgttttggaaggatttatagttttggtagtggtttgtttttaggttgtagttgatagtaattaaggagttttagttttgttttagagtttggatttaggtgggttggtttttagttttaggttttatattaggggttttgtttggagtttaggataagtagggagggggatttttatttatttagttttttggaggaagtggtgtttttttggggttgaagttaatagtattttttgtggttatattgggggttttggaggtttaagggagggtaggggtggttag

SEQ ID NO: 240 - DNA, 2381 bp, Artificial Sequence
  chemically treated genomic DNA (Homo sapiens)
gtgaaatagttaggttgttgtttttaggatgtggtgggtgtatgttttgtggggtttggtgagtggaggtgtgggggttggggtgtgtgttggtggtggttggtttgatgtggattttttgggtttggggtggggatgtgggggtgtttatgttaatgttagttggttttgtttatttggtgtttgttttgtttgtgtggtttgttggttgtgtattgaatttagataggtgttggttaagggtgtaggtgtttgtgttgggttttagttatgttagtggtgatgtgttttggtgtgttgttaggatggttgagtggtttaaggtgttgtgtttaggttgtagttttttttggaggtgtgggtttgaattttatttttgataagttgattttttggtttgtttgttggagggtaatgtttatggtaattttggagtatttttggttgttttttgttttgagtttttgtttgttttttagattttagtttttttgaagtaagtttttaaaatgttgttgttttttaggtatgtttgttttttttgtttatttgttggttgttgtagaaatagtttaggattatgtgttagtgtttgtgattttttattaattgttttttggatagatgttttttttattattttatatgtttttttttttggttttatatatagtgagtgattgtgattattttttatgtttttttttgtttattttttttgtttgttttttttttatttgtttaaatagatatagtttagattttttttttatttttttttttttttttttttttttattggtttttgtttattgtttattgttttgaattgttgttgtgttgtttagaggtgttttggtttgaatagtttgtttggttttattttttaatttttgattgttgagtagtagtgagtgatttgtttgtggagttgtatatatgttttttattagaggtatgttatttaatattttgtttttttttttgattttttggattttggttgtgtattttattttgttgatattttagttaggttgttgattttattttgttatttgtgttttttttttgttaatatttgtttgttggtttatttgtagtttggatgtttgttggttagaggtagtgggaattttgtatatagtttggtaggtgagtttaaatttggaaagatagtttaagaggaattatgagtggaagttttagatttttgttatttgtttataaatgtttggttttgttgggattagttttgtgttatagtgtatttttatgtgggaagttgtggtttgggttgttttagtaatatttagtgtgttttttttagggttagttagttgtggttttgtttaagtgtttttttgttttttttttgtgttttagtttttttattagtttagggggttggattttaagtgtgagttggtggtgtgggttagagtgtaggagtgaggtgtttatggatttggtttgtgtttttgagttgtatgttatggttgtgagatttgttttttattgttgtttttgtttgttgatatatttattttgttttttatttgttggtgatataagtgagaaggttggttttatggtggtgaaaaaaaaaaaatattttatgaaagaaagaaagaaagaaagaaagaaagaaagaaagaaagaaagaaagaaaggaagaaagaaagaaagaaataataaaaataaaatataaaaattttgggtttgtgttggggatttgtgtttagtaaggtttgttatagtaaatttgtttatatgggtatttgggtgtgggttatggttggttttttttttggagattttggtgggtagttttttgattttgggtggtagagaaagtgtaagatgggatgagttggtttttttttttttgttttttttttgtgttttgttttaggttttttgatgtgatgagagtttttttttttgtttgttttattgggttagttttttgtggatgttgtaataggatggaggtttatggtaggtggtgattagtgaatggtggttggtggtgagttttgttgtgttagtttttgttggtgtttgttattggtgtatgggtggtttagtggtagaatttttgtttgttatgtgggaggtttgggtttgatttttggtttatgtagtatgtttttttattttggtgttgtagtagtattaaggtgtagttgtgtttgtttttgttgtttttttatatttggggtgtgtgagtgagtttggtattggttgtgtttttatgtgtgatggttttttgtttttttttttgtgttttttttgattgatttagggatgagtttattttttgtatttatatattttggtgataataatttttttagatatgagagtgtgttagatat

SEQ ID NO: 241 - DNA, 2381 bp, Artificial Sequence
  chemically treated genomic DNA (Homo sapiens)
gtgtttggtgtgtttttgtgtttggaggggttgttgttattaaggtgtgtgggtgtggggggtaggtttatttttaagttagttgagagaggtatggaagaaagggtagagggttgttgtgtgtgggagtgtagttggtgttggatttgtttgtgtgttttgagtgtaaggaggtggtagaggtgagtgtagttatgttttggtgttgttgtagtattaaaatgggagggtgtgttgtatgggttgggaattgaatttgggttttttgtgtggtaggtgagaattttattattgaattatttatgtattgatggtaaatgttaatggaagttggtatagtggaatttgttattagttgttgtttattggttattgtttgttgtgggtttttgttttattgtagtgtttatgagaggttggtttgatggggtgagtagaaggggaggtttttgttatgttgagggatttgaggtggggtgtggagggagagtggagggagagaggttgatttgttttattttgtgttttttttgttgtttagggttgagagattgtttgttggggtttttaggggaaggattggttgtggtttgtgtttgaatgtttgtgtgggtagatttgttgtggtgggttttgttgagtgtggatttttggtatagatttagagtttttgtgttttgtttttgttgttttttttttttttttttttttttttttttttttttttttttttttttttttttttttttttttttttttttgtaaggtgtttttttttttttattattgtggggttagtttttttatttgtgttattagtaggtgagaggtgggatgggtgtgttagtgagtgggggtggtgatggggaatgggttttgtagttgtggtgtgtggtttagaaatgtagattaggtttgtgggtgttttgtttttgtgttttgatttatgttattggtttgtatttggggtttggttttttgggttggtagggaggttggagtgtgagaaaggagtggaggagtgtttaggtagagttgtagttggttgattttggagaaggtgtgttgggtgttgttgggatggtttaggttgtggttttttgtgtggggatgtgttgtggtgtagagttggttttggtggggttaggtgtttgtgggtgggtgatggggatttagggtttttgtttgtgattttttttgggttgtttttttgggtttggatttgtttgttaggttgtgtgtagggtttttgttgtttttggttggtaggtgtttgggttgtaggtgggttggtaggtaggtgttagtgggaagggagtataggtagtgaggtgggattggtgatttggttagggtgttggtagaatggaatgtgtggttggggtttgaggggttggaggaaaggataggatgttggatggtgtgtttttggtgggagatgtgtgtgtggttttatgagtgagttgtttgttgttgtttagtggttagaagttggagggtgaaattgggtgggttgtttaggttaggatgtttttgggtagtgtagtggtgatttaaggtggtgggtggtgggtggaggttggtgggaggaaggagggaaaaggaggaataggggaagaatttgggttgtgtttgtttgggtgagtgaggagaaggtgggtggaggagataggtagggaagagtgtggaaggtggttgtggttgtttgttgtgtgtggggttagggaagagggtgtgtgaggtggtggggagggtgtttgtttgaagggtaattggtagagggttgtgggtgttggtgtatggttttgggttgtttttgtgatagttggtgggtgggtaggaagaatggatgtgtttgagaagtggtggtgttttggaggtttgttttaaggggattggagtttggagagtgggtaagggtttaaggtaggaagtggttaaaggtgttttagggttgttatgggtgttgttttttggtgggtgggttaaaaggttggtttgttaggagtgggatttgaatttatgtttttaggggagattgtgatttgaatgtagtgttttagattgtttggttattttgatggtgtgttggggtgtgttgttgttggtatggttgggatttggtgtgaatgtttgtgtttttggttggtgtttgtttgggtttggtgtgtaattgatggattgtgtgggtggagtgggtgttaagtgaatggagttggttggtgttggtgtggatgtttttgtgtttttattttggatttaaagggtttgtgttgggttggttgttgttggtgtatgttttagtttttgtgtttttgtttgttgaattttgtagggtgtgtgtttattgtgttttaggagtagtggtttgattgttttgt

SEQ ID NO: 242 - DNA, 2514 bp, Artificial Sequence
  chemically treated genomic DNA (Homo sapiens)
tttttatttttttttttttttttttttttatatatatatagatatatatatatatatatatatatttatatttattgttgggttttttgggttgttaataggattaaatgaatgttttggttttatgatgtgtatgttatgttagagagttaagttagttaatattgtttattgggatagaaggaatgtattgaggaatgtattgaggattagaagttagaatttttgaatttgtaaatttttttttttttttttttttttttttgagatagagttttgtttttgttgtttaggttggagtgtttattgtaatttttgttttttgagtttaagtgatttttttgttttagttttttgagaagttgggattataggtatgttaattttttgtatttttaatagagatagggttttattatgttggttaggttggttttaaatttttgattttaggtgatttattagttttggttttttatagtgttgggattataggtgtgagttattgtgtttggtttgtaaattttttattttgtttagatattaattttagttttataaatagttatttaatatttttagtaaatggtgtgttttatattgatttgtttggttgttttattgtgtttgttatattgttgtgtaatgagttatttataaatttagtagtgaaaatagtagatatttattattttatatagttgtggagggttaggaatttaggagtggtttagtgggtgattttgggtgttatgtggagttatatggggttaatgtgttggttggggatgtagttatttgaagttttgtggggggaaggaggggtttttttaggtttgggaaggttgtggttgttttattatgtttttttttttattaggtttataggtttatagaagtaaaggttgagtatgttaggattgagttgagtggtttttattttttagtttatagttttttatagagtatgtaggggttgtattagggttgggatggggttgtgattaggttaggggagtattttgggtaaattttgttggggataggtttgttgtgtttgatgttgtgggagatgtatgagtagtgatttttattttattttattgtggttttgtgattttgagtgagaatgtattggttgggtttttagggggtgtttttttaggaatattttatttttgtttttgtgtgttgttgagggtttttagtgggtgtttttttgataatattttatttttgttgttgttgttgttgggggttttttgtgttttaggaggttttttagggtgatgttttggtttttgggttttttgattttatttttttagtttagtttttgaattttattttagattgagaggttttaggttggagtgatatggagggatgtgtttgatttttggaggataagaggtggtttattttatagtttttttagtgtgggagttttgaatatgggatttggagtattattgtttagtaaattttgttgtagtttggagagagtgttgtgggtgtttggtttgtttggtaggttgggtggttgttttttgttgagtttatagttatgttttatatgtaggatgtttgtttattatttggaggttttttagggattttgttagtttatggttgagtatagggtagattttattaatttatttataatttggttttttgatatattggtgttgtgaggaggaagatgtgggtatttttaggtttttggttttaggggtttgtgttggggtggggtttgttgatttgtattttggttggttttgtgattttgtttgtttatagtgagtagtttttggttaaaagttgtttattggattagttggtgttttgatggtagagtttgtagttgtgtgtaggaggatgaatttgtgtgtatgttttgttttagtgtgtttttggggttttttgagttggtttttgtgattagaaggatagtgttggttatgtaggtggtattttgggggtgtttagtatttattttttgttgagtagatgttttgggtggtaatggtttttgttaagtttgggtagtttaggttaggttttaatttttttgtttgagtttggttttttattttttggttaggttgatatttgttttttgtaggttttttttgttggttttaggtagtataggattgagggttgaagatgttgagtagttatttggtttgtttttttttagggatttgtgtggttttgttggtggtggttttggtttattatttttattggtgagtgaggttggggtttgggggtttgggtagttttgggggtttttattgtgtgtttttttttttttttagttttggattgttttttgtatgttaataaattttgtttagttttttgtaggggaatttttgggaggtagggaagtaggggatggtaggaatttattttgattttttttggggtttttgggtagtttttttatttttttgtaaaggggtttttgtttagaatatttttgaaggagttgagtggttttat

SEQ ID NO: 243 - DNA, 2514 bp, Artificial Sequence
  chemically treated genomic DNA (Homo sapiens)
atgaaattgtttagtttttttaggaatgttttgaataaaaatttttttgtagaaggatgggagagttgtttaaggattttaggagggattagaatgagtttttgttattttttgtttttttattttttaggagtttttttgtaaagggttaggtagggtttgttgatatgtagagaatggtttagggttggaagaggaggggagtatatagtaaaggtttttaggattgtttaggtttttgggttttggttttatttattagtagaagtaataggttaaagttattgttagtagggttatatagatttttgagaagaggtaggttgggtagttgtttagtatttttagtttttggttttgtgttgtttgaagttggtgagaaggatttgtggggagtaggtgttagtttggttaaagggtgaggagttgagtttaagtggagggattaggatttggtttgagttgtttaggtttggtaggggttgttgttatttagagtatttgtttagtaggaagtgggtgttgggtatttttagggtgttatttgtgtggttagtattgtttttttagttatagagattaatttaagggattttaggagtgtgttgaagtaggatatatatataggtttgtttttttgtgtatagttgtgggttttgttgttggggtattggttaatttaataagtagtttttggttaggagttgtttattgtaaataggtagagttatagggttagttaggatgtaggttaatgagttttattttagtatagatttttaggattagggatttaagagtgtttatatttttttttttatagtattagtgtgttaaggggttaggttgtgggtgagttggtgaggtttattttgtgtttagttgtgggttagtaagatttttgaaaggtttttaagtgataggtaaatgttttgtatgtggggtatggttgtgggtttaatagagaatagttatttagtttgttggataggttaggtgtttgtgatattttttttaaattgtagtaaggtttgttaaatggtggtgttttgggttttatgtttagagtttttatgttggaagagttgtggggtgggttgttttttattttttagaagttaggtatgtttttttatgttattttagtttgaaattttttaatttgaaatggagtttaaaggttaaattagggagatgagattaaaggatttagggattagagtattgttttgggaaattttttggggtgtgggaggtttttgataataatagtgatgggggtggggtgttattaagggagtgtttgttagaggtttttgatagtatatggggatggggatggggtgtttttaagggagtgttttttggaggtttggttagtgtatttttgtttagggttatggggttatagtgggataaagtgaaagttattgtttgtgtattttttatggtattagatataatgaatttgtttttagtagggtttgtttaggatgtttttttagtttggttgtagttttgttttagttttggtgtggtttttgtgtgttttgtgggaaattgtggattgagaggtgggaattgtttagtttagttttgatatgtttagtttttatttttgtgaatttgtgaatttggtggaggagagagtgtgatggggtagttgtagtttttttaggtttgggggagtttttttttttttttataaggttttaggtgattgtatttttggttaatatattgattttatgtgattttatgtgatatttagaattgtttgttaagttatttttggatttttgattttttgtagttgtgtgagataatagatgtttgttgtttttgttgttaagtttgtgggtaatttgttatatagtaatgtaataaatatggtaaggtaattaggtagattaatatgaggtgtattatttattggaagtattggatgattatttatagggttggagttagtgtttgaataaaatagaagatttgtaggttgggtatggtggtttatatttgtaattttagtattgtgggaggttgaggttggtggattatttgaggttaggagtttgagattagtttggttaatatggtgaaattttgtttttattaaaaatataaaaaattagtatgtttgtaattttagttttttaggaggttgaggtaggagaattgtttgaatttgggaggtagaggttatagtgagtattttagtttgggtaataagagtaagattttgttttaaaaaaaaaaaaaaaaaaaaaaaaagatttgtagatttaagaattttgatttttaatttttagtatgttttttagtatgttttttttattttaatgagtgatgttaattaatttagttttttagtgtaatatgtatattatggaattaagatatttatttaattttgttagtagtttaagaaatttaatagtgagtgtgagtgtgtgtgtgtgtgtgtgtgtgtttgtgtgtgtgtgagagagagagagagagagaaagtggggg

SEQ ID NO: 244 - DNA, 2325 bp, Artificial Sequence
  chemically treated genomic DNA (Homo sapiens)
agttttagtagtttggtttggttgtggtggtggtagtagtagtagtggtggtggtggttgtggtggttttggggtatttgtagtattatgtatttgtttgtattgttattatttataatgtggtggatttgtggagattttattgttttattatgggtagggtggggttttggggtatttgtgttttgtgttttttgtgtttttggagtaaattttttatttttagtggaggaagtgggagtttggggatagggtgaagagagaggatgggtttttagtgtaattgtagagttagttatagaagttttatgaaagtggaagttagtttgttagtttttttatttagtttggtgtgttttatttttagtagtaggtgtttgagtattgttttattaatattggggttttagggattttgaatgttatggtggataaattagaggttaattgtttgggatttggggtgggtgtgtttgaatttgtgtggtatttttgtgttggggtggttaaagtgttttgatgtttttggttaagtttgtgtgtttttttgtttggtttaaagggaggtgattagatagtgtaagtttttatttttttttaattttgtgattttgtattttgtgtattgaagatttttatttgttttgtatgtttttttttttttttgttaagtaattatgtgttttgaaatgggaaagggatatagatgtttggttgggtttttttgggtgggtttttgaaatgtgttttggttagtatatggggtgggagtattttgtttgagttttatttttttattttttttttgttggtttgtaggaggttttgatgttagttaggtatttaatggtaagaggatgaggatggtgtttattagtatgtaatttttggagttggagagagaatttttttttaatatgtatttgttttgattttggaggattgaaattgttatttatttgaatttgttggagaagtaggtgaaaatttggttttagaattgttgagtgaagtataagaaggaggggaagggtatgtagaggaatagttatgtgggttgtaagtgtgttgggagttaggtgtattatgtgtgttttgaggatgaggattttttgttgttggttttagttaatgatgataaggagattttttttttatgagggagggtttttttttttatattttttgtttttggtagattaggtaatgttaaggtgtggggtatttaggggttagaatttttgtttattgtagtggttttatttggagaagaaatgaatttggaagttttggaatggataagttgggatttgattttttgtgttttttttttgatttgtttatttaggattttaatttgaagttatagatttttttaaaaaatgtaaataatttataatttaatttatttttgttgtataatagaggaaaaatagggttggtttaagtttaatattgtatggggtttttgaaagtatatgttagttttttatttttatttttttttagaatttgataagaatataggatttattgattattttttgttgttgtttttaaataaaaatatttaagttgaaaataatttagaaaattagattttgtaggttttgttttttgaaattttgtttggggagaatttaaaatttaagttgttggaagtttttttgtatgtgaataggtttatataaaatttatatttatatttatttaaataaatgaaataaaaattagaattttaaatttgtggtgtttgttttttttatttttttttgtttttttttttaatgtttagagaaaggtatatgtaggaaaaagttgtttgaggaatttgaggaaaatgttgagtaagaatttggtaatgtgggttttttgattgagggagtttgtggtttaatgggttttttatgtaatagaatttttgttaaggagatatttttagttatgatggtatttattaggtagtgtttttttatttttaaaataggtaatttttttatagttgataggataaattattttatttggaatgatattgattattaatgataggtaaatttttatttagtaaggaagggtaaaaattttttatttagtttttgtttttttttttttatttttttattttttttagtatgaaaatttgaattatgtgaaggaatttgtagagttagaatagttttaggaagagtaataatttattaaataggttagaagtaaatagtggaaatttaataatgatgttataagtagaattagtgggttttttttaatgttaagaaaataaaaagttagggataggaagtattttgtttaaagatttat

SEQ ID NO: 245 - DNA, 2325 bp, Artificial Sequence
  chemically treated genomic DNA (Homo sapiens)
ataaatttttgaatagaatattttttgtttttgattttttgtttttttaatattgagggaaatttgttaattttgtttgtagtattgttattaagtttttattgtttgtttttgatttgtttgatggattgttgttttttttaaaattattttgattttataaatttttttatataatttaagtttttgtattgagagaaatgaggaagtagaaagaagaaaataaaaattagatgggggatttttatttttttttgttaaataaaggtttatttgttgttaatggttagtgttattttaaatggagtgatttgttttattaattgtgaggaggttgtttattttaaggatggagaggtattgtttggtagatgttattatgattaaaggtgtttttttggtgaaagttttgttatatagaaaatttattgagttataaatttttttagttaagagatttatattattaagtttttatttaatattttttttgaattttttagatagtttttttttgtatatgtttttttttagatattggaggagggggtaggagaagatagggagagtaaatattatagatttaaaattttggtttttgttttatttatttaaataaatataaatataaattttatataaatttatttatatataaagggatttttagtgatttagattttaaattttttttaggtgaaattttagaaagtaagatttataaggtttaattttttaaattatttttaatttgggtgtttttgtttgaaaatgataatagaaaataattaataaattttgtgtttttattgagttttgaaagagagtagggatggggaattgatatgtgtttttaaaaattttatatagtgttaaatttaaattaattttgttttttttttgttatatgataagaatgagttgaattataggttatttatattttttaaaaaaatttgtaattttaagttggagttttagataaataggttaagaaggagatgtgaagggttaggttttggtttgtttattttagaatttttaggtttgttttttttttagatgggattattgtaatgagtaaggattttggtttttgggtgttttatgttttggtgttgtttggtttgttaggagtgggggatgtgagggaggaggtttttttttataagggggaaatttttttgttattgttggttgaggttggtgatagggagtttttatttttggagtgtgtgtagtgtatttggtttttgatgtatttgtagtttgtgtgattgtttttttgtgtgtttttttttttttttttgtgttttatttggtggttttgaaattagatttttatttgtttttttgataggtttaggtaagtggtgattttaattttttggagttgagataggtatatgttggaagagaattttttttttagttttaggagttgtgtgttagtgaatgttgtttttatttttttgttattgggtatttggttggtgttagagttttttgtggattggtgaagagagggtagagaggtaaggtttgggtaaggtgtttttattttatgtgttaattaggatgtattttagggatttatttggggaagtttagttgaatatttgtattttttttttattttaaggtatgtggttgtttagtggggaagaaaagagatgtgtaaagtaaataaaggtttttgatgtgtaggatgtgaagttataggattaaagagggatgggggtttgtattatttgattgtttttttttgagttaagtggagaagtgtgtaggtttagttaaaaatgttaagatgttttagttgttttgatgtggggatgttatataggtttaaatatatttattttaaattttaagtagttaatttttggtttatttgttgtgatgtttgaggtttttaaggttttagtattaataaggtaatatttgagtatttattattaggagtaaaatgtattaggttgagtggagaagttggtaaattaatttttatttttgtggaatttttgtggttgattttatggttatattaaaagtttgttttttttttttattttgtttttgggtttttattttttttattggaggtggaaagtttgttttaggagtgtgaaaggtgtggagtgtaggtgttttaagattttgttttatttatggtgaggtagtggaatttttgtgggtttgttatgttgtaggtggtggtggtgtagataggtgtgtggtgttgtgggtgttttaaggttgttgtggttgttgttgttgttgttgttgttgttgttgttgtggttgagttaggttgttggggtt

SEQ ID NO: 246 - DNA, 2541 bp, Artificial Sequence
  chemically treated genomic DNA (Homo sapiens)
aatttagttttatagtttatattttattttaaaatatagtttaattgggttaaaaataaatatttgaaaattaaatataagaagaaaatattaaattattagaaaatattggtaaatattgagttatataaatttgatattgttaaaatatttaataagtaataaattatgataattgtgtaaggtttaagtttgtgtgtgtgtgtgtgtgtgtttgtgtgtgtatgtgtgtgtttatttgtagggtaaaagtttagaagaatttatattgaaatgttgaaagttattgggtaaagggttttgggttttagaggtttttgatgattgtaattattttgtttttttaattgaatgttttttttttatattgtatatgattatttttgaaaaaaaaaaataaaagagtatgttgttttttttttgtagggaggtagagtttaggtggttattaaggggttgttgttatagtttagggaaagttagaatggtaggtatgggagttttgggaggggttttaattaggtttgttttttggttttagaaagagtaggggtttgtagtgaagtttatagagttttttgtgggttgtatgggttgtttttaggtttttatttttttttttagttatggttgtttagtgtttttttatttggtggtgtggggatattgggaggttttttgggttttttaatttttttatttaatttttagtttaggtttggttttttaggatttagtttttagtttttgtgaggttgggttattttgtaggattgtagttttgggttttttgttttggtgttagggttttggggtttatgaatgtagttttagtatttgggaggttgaggtgggagaattatttgaatttgggaggtggaggttgtagtgagttgagattgtgttattgtattttagtttgggtgatagagtgagattttgttttaaataaataaataaataaatagtagttaatattttttgagggttttttagggttaggtgtggggtagttttatgtaatttttaagtaattttgggaggtaggtattattgtttattgttttttttgattttagagataagaaattaagatttagaatataagaaatttgtttaaggttaaggagaagtggaggtgtggggaggaaataaagttatttgatattagagtttatgtttttaaattttaagtttgggatttttgattaaattttgtttttgtttgtattttgggaagattttttttttttttaggtaagtgtttgtggggtttgagtttttgatagtggggttttaggagttatgttgtggggtttgttatttggtttttttttgtatgtgtgattgtttatttgagtgtagtggttggagttgggattttagtgtagtttttgagtgtttatgttgatttttttaattataagaggtttttgtgttaggtttttagatttggttaattagggaagatttttttttgttatagaatggggttgaggggtttaggaaataggtagtttttagttataaattattgtgttgtttttgttggttttttttttttattgagttttagtttttttttttataagttgggttagtagtgtttattttataggttggtgttagttttgtaagggttttattattgtggttggttagatttttggtgggttagttttggtgttgtggttatttagtttgatgatttttggttaggtttagttttaattgttttaaagaattttggatttgtattttgagtttggtgttttagtggtgaagttgatgggttttgtaggagtttttgtggtgagaattgagttttggagtttttggagtttttggagtttttggagttgtagttggggtagttttttttttgttgggagtttagtgtttttgagagtttagaaatttattgtgtgtaggagttggtgtgggtgttttgggtaggttagatttttgtgagttgtagttttgaaattgaggttggtgtagatttgttttgggagttaggaggtgggatttgtttttgttagtttgtgagttttggttaaggttagagtttgtgaggggaggggtgtggggtgggtggagagttagttgagtgggggtggtgtttattggtggtgggattatggtgggagtgtagtgtattttttttgggtgggtttataaatgttatgtaaaagttaattttgtaggggtttgtgtttttttttgtttaggttaagaagatttattgtggatttttggagaatttttagggttttgaaaagttttaagtatttagtagggttggtagttttgagtgttggtaaggttaagtgggttagaggagatttttgttaagttggtgatttatttatttgtttatttttttttatttttgatgggttaagtatttgttatgtgttatggatatagtagagtgaaaggagatgttgttttttgggaatttgtagttgtttgtagaggtggttttttagtagttgtgtatttgggtggatagtggtgtttttgtttgtttagtgttta

SEQ ID NO: 247 - DNA, 2541 bp, Artificial Sequence
  chemically treated genomic DNA (Homo sapiens)
taggtattgggtgggtagaagtgttgttatttatttggatgtgtagttgttaaggggttgtttttgtaagtggttgtaaatttttggagggtagtgtttttttttgttttgttgtgtttgtagtatatggtaggtatttggtttattaagagtgagagagggtgagtgagtgagtgagttattggtttggtgagggttttttttgatttatttagttttgttagtgtttagaattgttagttttgttgggtgtttgggattttttaaagttttgggaattttttaagggtttatagtaagtttttttgatttaagtgggaaagagtgtaggtttttgtggggttggtttttatatggtatttatagatttgtttggagagggtgtgttgtgtttttgttatagttttattattggtgagtgttgtttttatttggttgattttttgtttgttttgtgtttttttttttatgggttttggttttaattagagtttgtggattggtggggataggttttattttttggtttttaggatgggtttgtattaattttagttttggggttgtggtttatagaagtttaatttgtttgggatgtttgtattaatttttgtgtgtggtgagtttttgggtttttgagagtgttggatttttggtggaaaggaggttgttttggttgtagttttgggggttttgggggttttaggggttttaggatttggtttttattgtaagggtttttgtggggtttattaattttgttgttgggatgttgggtttggggtatgggtttggagttttttggagtaattgaggttgaatttggttaggggttattaggttaaatgattgtagtgttaggattggtttgttgaggatttggttggttgtggtggtagggtttttatggagttggtgttaatttgtggggtgggtattgttggtttggtttatggaagagaaaattgaggtttgataagagaaagggattagtgaaggtgatgtgatgatttgtgattggggattatttgttttttgggttttttgattttattttgtgatagggaaaggttttttttgattggttaaatttgggggtttggtatgagggttttttgtgattggaggggttgatgtgagtgtttaggggttgtgttggagttttagttttagttattgtgtttaagtggatggttgtgtgtgtagagggaggttggatagtagattttataatgtggtttttggggttttgttattgagagtttaggttttgtgggtatttgtttaggagaggaaagaatttttttaaagtgtagatagagatggaatttaattaggagttttagatttggagtttggaggtatgggttttggtgttaggtgattttgttttttttttatgtttttatttttttttgattttgggtaagttttttgtgttttgaattttagttttttgtttttaaaattgggaggggtaatgaatagtagtgtttgttttttaagattgtttgagaattatatgagattgttttgtgtttggttttaggaaatttttggagaatgttggttgttgtttgtttgtttgtttgtttgagatagagttttgttttgttgtttaggttggagtgtagtggtatgattttggtttattgtaatttttgttttttgggtttaagtgatttttttgttttagttttttgagtgttagaattgtatttatgggttttagggttttagtattagaatagagggtttagagttgtagttttgtagggtggtttagttttatagggattagaagttgggttttggagagttaagtttgggttgggaattgggtaggagggttgggaggtttaggaagttttttagtgtttttatattattaagtgaaaggatattgagtggttatgattgggggaggaggtggaggtttggaggtggtttatatggtttataaggggttttatgggttttattgtaggtttttgttttttttggggttaaagggtaagtttgattgaggttttttttaaggtttttgtgtttgttattttggttttttttggattgtgataatagttttttggtggttatttggattttgtttttttgtagggggggaatgatatatttttttattttttttttttagaagtaattatgtataatataaaaaaagaatatttagttaagaaaataaaataattatagttgttaaaaatttttgaaatttaaaattttttatttagtaatttttaatattttagtgtaaatttttttaggtttttattttgtagataaatatatgtatgtatatatagatatatatatatatatatataaatttaagttttatataattattgtggtttgttatttgttgggtgttttgatagtgttaggtttgtataatttaatatttattaatattttttaataatttaatgttttttttttatatttgatttttaagtatttatttttaatttaattggattgtattttagagtaagatgtgaattatagagttagatt

SEQ ID NO: 248 - DNA, 2501 bp, Artificial Sequence
  chemically treated genomic DNA (Homo sapiens)
tttgtaaatggagatatttttattatttttatagtattatatgtttttaaagtttgtatttatattttgggtgataaatgaaggataagatttttttttatttttgtgaggatgattatagtatgattggatgggtttgttatgatttttatttttttttgtgtttttattattgttttattaattttagtttttttttatagggtagtatagaatttaattagtagaaagagatttagttatgtagattagagatttgtttaagtgatggtatgtaagaattaggaaggaaagttttttgtttaaatattaataggttttttttttaaagtaattattattttttaaatttaatttataaggtgatagtatttttaaattaattaaattagaattttgggttggataattttaaatatgatttattagtattttttattaattattggttttttaggtttttaagtttatttattaggaattttatttttaatattattttattaattttagttgtaaataagagaatatttaaaggttgaggaatttttagtggtaaagttttgtttatgttaagtaataaaggataagttagtttttgttgtgattattttgttgtattgataagttatgtatttttatttaaggatttaaatttttattttttttaagaattgggttaaaattgataaattaaatttatttatggtttattgattaaaggttgttgtataataagtttttgttatgtttagtagttggatttatagtgttagaaatttataattgtttgatttttttttttattatattgtgaaaattgttttttaaatgtaattaattttaaaattttaatagtattgtggttaggtgtggtggtttattattgtaatattaatattaggtataggtgaggggattgaggttaggatattgaaattagtttgggaaatatatggagatttggtttttggaaaaataattagttttgtgtggtggtgggtgtgaggttttggttaattgggaggttatagtgagttatgatgatattgtattatagtttgtgtgatggtttatgttagtaagttttggagtatttgaaataagttgtgttgggtattttatttattggagagtgattagtgattgatgtttatttatagtgattagagatgtatgttttgatagtagtataaatttagtaggtgtgaataaatggtaaagagaaattgggtaaataagtattatggttttttagttgagaaagtgggggttttaaaaagggttttttgttgatagaaagggatgtttaattattgaaattgtagagggtgtggttttggtgtttgagtgtgtagattatatttatggtggtgattgttttgtgtttggtgtgttttgtataggttatggtgttttggattatgttttttaggaatatttttagtattttgtgagtttttttgtagatgaggttggagatgtgttttatgttgttgtggtgagtaaggtgttggatggttggtttggtgatgttttggatattgttgtgtagtattttatggtggtgtttagtgttgtttttgttaagattttttttgtttttgttgtggttagatatgatgagtaagaggagttttatttaatgttttgtgaggattttggtttgaggtagtgtttttatatgatagttggtggattgaattgagaatttgaaagaagttggtgggaagttttgttttggtgggggaggggaaatttaaagggttaaattgaaatagggggaaaaaaaaagtgagttttttgtttttgtgttttgaattttgtaatgtgtatagtattttgttattatgttatgaggttttaaaaaattgtttttgaatgtagaagatatatattaatattgtgggaaatataagaaaggataagaaattaagaaattataatgttattttattatataggttagttaattatgtattttgtagagtagttgtatatatttttttaagaaaatgtatatagtgttgtatatggagttttgtaatttttttatattgattataatttaattaatttttattaaagagataaaagtgatgttttggtgtttatgttttttaggaattattaatagttataattagttttttagtaattttttaattggttgtattttaaaaataatgttttttatatttaatataaatgtattttttttttatatttgggattaatattgaaatttatgattttattatattaaaatttaaattttattatattaatatttaaaattgtattagaggttttatgatttggtattatgggtttttgtattattttttttttaaattttttaatttgttttattaaggtttttggataattttagagattttttgtgaagtttgaataaaatttttttgagattttgataattgtattagttttaggatttaattggaatagaattaaaatttttaaaataagtttttata

SEQ ID NO: 249 - DNA, 2501 bp, Artificial Sequence
  chemically treated genomic DNA (Homo sapiens)
tataagagtttgttttaaggattttaattttattttaattaagttttaaagttaatgtaattattaaaattttgaagagattttatttaaattttataaaaggtttttaaagttgtttagaaattttggtgaaatagattaggaaatttggaaaggaaataatgtggagatttgtagtattaaattatgagatttttaatataattttaaatattaatgtaataaaatttaaattttggtgtaataaaattataaattttaatattggttttaagtatagagaaaaagtatatttatgttgaatgtggaaaatattatttttaaaatatagttgattaaaaaattgttggggaattgattataattattgataatttttaagaaatatagatattaaaatattatttttatttttttaatagaaattggttaaattataattaatataaggaggttataaaattttatatataatattgtatatatttttttggaaaaatatgtgtaattgttttgtaaaatatatgattaattagtttgtgtgatgggataatattgtagttttttaattttttgtttttttttgtattttttatagtattgatgtatattttttgtgtttaaaagtaattttttaaagttttataatgtggtaataaaatattatgtatgttataaaatttagaatatggaaataagaagtttgttttttttttttttttattttggtttggttttttagatttttttttttttattggggtgggattttttgttgattttttttaggtttttagtttggtttgttaattgttgtataaaggtgttgttttaggttagagtttttataaagtgttgggtgagattttttttgtttgttatgtttggttgtggtaaaggtgggaagggttttggtaaaggtggtgttaagtgttattgtaaagtattgtgtgataatatttagggtattattaagttggttatttggtgttttgtttgttgtggtggtgtgaagtgtatttttggttttatttatgaggagatttgtggggtgttgaaggtgtttttggagaatgtgatttgggatgttgtgatttatatagagtatgttaagtgtaagatggttattgttatggatgtggtttatgtgtttaagtgttagggttgtattttttatggttttggtggttgagtgtttttttttattaataaaaggttttttttagggtttttatttttttagttgaggagttgtgatgtttgtttgtttagtttttttttattatttgtttgtgtttgttgagtttgtgttgttattggagtatgtgtttttagttgttgtaagtaggtattagttattaattgttttttagtaaataaaatatttaatataatttgttttaggtgttttagagtttattgatatgggttgttgtgtagattgtagtgtagtgttattatggtttattgtagttttttgattagttggaattttgtgtttattattatgtaaggttaattatttttttaaagattgggtttttgtgtgttttttaggttagttttgatattttggttttaatttttttgtttatgtttaatgttggtattatagtagtgagttattatgtttggttatgatattgttgaggttttagggttagttatatttaaggggtaatttttgtagtgtagtggggaggaaagttaagtagttataggtttttggtgttgtgaatttaattgttgaatatagtaagaatttattatgtaataatttttaattagtggattgtaaataagtttagtttattggttttggtttaatttttgagaaaggtgagaatttgaatttttgagtagaaatatgtagtttattagtataataaagtgattataataaagattaatttattttttgttatttaatgtgggtagagttttattgttgagaattttttagtttttgagtgtttttttatttataattgaagttgataagatggtattaaaagtgagatttttagtaagtaaatttaaaggtttgaaggattagtgattaatgggaagtgttaataagttatatttgaggttatttaatttgagattttgatttaattggtttaaggatattattattttgtgggttagatttgaaaaataataattgttttaaggaaggaatttgttggtatttaaataaaaaatttttttttttgatttttatatgttgttatttagataaatttttggtttatatggttggatttttttttgttagttaaattttgtgttattttgtgaaaaagaattgagattaataaaatggtagtgagaatatagggaaagataaaaattatagtaagtttatttagttatgttgtagttatttttataaggatagggaaggattttgttttttatttattatttaaagtgtgagtataaattttaaaaatatatgatattataggaataatgaagatgtttttatttgtaaa

SEQ ID NO: 250 - DNA, 2257 bp, Artificial Sequence
  chemically treated genomic DNA (Homo sapiens)
tttgttttaagggttatggtgtttataataggatgggtatgggatggtgtatttgaggtttgagattttaagaggttttgttaaggaattggttagtggagaaggggttattagttttagggggtaggagagttagggagggtgtatagttgggttgaggtgggagtggttttttttggaaaggtggggagggtggttttgtgttgatggtggaggttattttggtttgttgtattatggtttagttttgttttaggtttgttggggtattggtgggatataggtgaggtggggttttggttaagaattgtgaggtttgtttattaggtgggttttgtagtgttggtatttggttagggtagttaggagagaggggaggatttggggttttgtttttttggtttttaaggttggggtgttgttggtttttatgtatttatagaaaggttagggtgaggtagttggagtttttaaggattttttttttgaagattttttggagttggttttttggttttattgtgagttaggttttttttttggaggttaagattagagggttggatgtttattttggttttagtttggtttttaggttttatttgttttttggttgtaggtgaaggtttttattttggggttggtttttatggaaagagtttttagattttagaaggtatagggagaagatgttaattaatagttttgtatttgggtgtttttgaggtggggaataggaaagtttgttgggtaggttaggtgtgaaggtagaggttatgtatagtggttggttatatttgtttgtagttgtttggaaattttattgggatttaaggttgtaggtttttattaaataggtttgttttttgtgtaggtttttagggaataggtttgttttttgtgttttttttgggtttggttgagataattttttgtttgttgttatgttggtaatattttgttattatttttgtttttttttatattgggttgatgttggttgtggttttgagtagagtggatagggtagttttgtttttgtatgttgtttttggagttatagggttttgtttagttttttagtttttgttggaaaataatttttgtaaaaggttattgttaggagtttttattttttagtttatatgggtttttttagggtttattttttttgttatatttagttattgtaagaaaagggttttagagggtttttgttttaaaattttggaggtattgtgttgaggagggttgtgggtgggtttattggtttagtgttgttttattttttgggtttggtttagtttatgttattaaagggatttttgttggtggttgagtgtggtgggggtttgtatggggtatagaggttggagttggtgtttgattttttttttgtaatgtagggtttgattttggtataaggtgttatggttgtgtagtagttgttgagagtatttaggttttttttggattgggagatgttgaagttgttgaaggaatgttttagttttttgtggtttatggatgggatggagatggatgtgttgttgttttgtaggttttttttggggggtttgtagtttggggtgtttttttgttgtaggaattttatgttggtgtggttgtttttgttgtaggtggatagtgattgtttgtgggtaggtggtggtgggatgtgtattagggagttgtggttttttatgggggaggtgttgtggttttggtgtgggtggttttgtggttgttaggaggtggagggtggatattggatagggggtgtggttgggggtgttgagaagtttttttggtttgtggagttgttggagtgtatgattttgataatgtagttgtgtttgttgatatgtttttggttgttttttgggttgtggtatggtggtgttggttttggttttttggttttaaagtaggttttggtttttgttggggggatgtttatttgttgtatgtagatatttattaggaagtttagttttttttttatggataagatttgtaaaaggggttgttgggttggggtgtgagggtttgttttaggagatgtggggatttaggttgtttttaggaaatgggggggtttaggttggttttaggaaataggagagatttaggttagttttaggaaatgggggatttaggttagttttaggagatgtggggatttgggttgtttttaggaaatgggggggtttaggttggttttaggaaataggagagatttaggttagttttagga

SEQ ID NO: 251 - DNA, 2257 bp, Artificial Sequence
  chemically treated genomic DNA (Homo sapiens)
ttttgggattagtttgggttttttttgttttttggaattagtttgggtttttttattttttgggagtagtttgggtttttatattttttgggattagtttgggttttttgttttttgggattagtttgggttttttttgttttttggaattagtttgggtttttttattttttgggagtagtttgggtttttatattttttgggatgggtttttgtattttagtttagtagttttttttgtaggttttgtttatggagaagaagttggattttttggtgaatatttatatgtagtggatgggtatttttttgatagagattgaggtttattttggggttaaagagttggagttggtgttgttgtattatagtttggaagatagttgggagtatgttgataggtatggttgtattgttaagattgtgtgttttagtagttttatgggttagaagaattttttggtgtttttggttgtgttttttgtttagtgtttgttttttattttttggtagttatagagttatttgtgttagggttatggtattttttttgtgggggattatggttttttggtgtgtattttgttgttgtttgtttatgagtggttgttgtttgtttatggtgggggtaattgtgttagtatggagtttttgtggtaggaggatattttgggttgtaggttttttgaggggaatttgtgggatagtgatatgtttatttttattttgtttgtggattatgaggagttggagtgtttttttagtggttttagtattttttagtttaaggagaatttggatgtttttaatagttgttatgtggttgtggtgttttgtgttaaagttaggttttatattgtggagggagagttagatattgattttgatttttgtattttgtgtgggtttttgttatgtttggttattggtgagggtttttttggtgatgtgggttgggttgggtttaggaagtgaggtggtgttgggttagtggatttgtttgtggttttttttagtatggtgtttttgaggttttgaggtgggaattttttggggttttttttttatagtaattgagtgtggtgggaagggtgggttttggaggggtttatgtgggttgaaggatgggggtttttggtagtgattttttataaaagttattttttaataggggttggagggttgggtagggttttgtggttttaggagtagtgtgtaggagtaaggttgttttgtttattttgtttagggttgtggttgatattagtttggtgtgaggaggggtgggagtgatgatggggtgttgttagtgtggtaataggtggggggttgttttagttgagtttaggggaggtataaagggtaggtttgttttttgaggatttgtgtaaagggtgggtttgtttggtgaggatttgtggttttgggttttggtggggtttttgggtagttataggtgggtgtggttggttgttgtgtgtggtttttgtttttatatttgatttgtttggtgggtttttttgttttttattttaggggtgtttaaatatagagttattggttggtgttttttttttgtattttttgggatttgagggttttttttatggaagttagttttgaggtggagatttttgtttgtagttgaggagtgggtggggtttgggaattaaattggagttagagtggatgtttagttttttggttttggtttttagagggagggtttggtttatggtggggttagggagttggttttaaagggtttttaaaaagggggtttttgggggttttagttgttttgttttggtttttttgtgggtgtgtgagagttagtagtattttagttttggagattgggggggtaggattttaagttttttttttttttttgattgttttggttgggtgttggtattgtgagatttatttggtgagtaggttttatagtttttagttagggttttattttgtttgtgttttattagtgttttgatagatttggggtagggttgggttatgatgtagtgggttaggatagtttttattgttagtatagggttgttttttttgtttttttggaggaaattatttttattttagtttagttgtgtgttttttttagtttttttgttttttggagttgatggttttttttttattgattgattttttagtggggttttttggggttttgggttttgggtgtattgttttatgtttgttttgttgtgggtattgtggtttttggggtagg

SEQ ID NO: 252 - DNA, 2434 bp, Artificial Sequence
  chemically treated genomic DNA (Homo sapiens)
  unsure (1598, 1841, 1846, 1848, 1869, 1871, 1873, 1874, 1878, 1880): unknown base
ggttttgtagtatattttgggagttgtagatagtaaatttggagttttatagagtattttatttttttattatttgtgggttaataggttgtgttagttttttagggttgttttatagtattatagattgggtatttttaataatagaatgttattgttttgtagtattggaggttatgagtttaagattaaggtgttagtagggtgggttttttttgaggttgtgtaggaaggttttgttttaggtttgtttttttatgtgtgggtggatattttttttttgtgattttttattaagggtgattttggtgagggttttaaagaggagatttggatagaatgttggtagataaatgtgttagtggaaattagagggtagataggattttatttatgtttagggttttttggggatagatttgtttaagtagtaattatttttaattgagttttgtttttggaaagttaggtaataggtggggttgggttttttgggatttgtttagtgatttgattatgtgggaggtttgtagtgggtggttgggtggggggtggtattaatgttattatgtttaattttattgtattatttattttttaggttttgtttttaattttttttgattaggttttgttttggtttttagttattttgttttagtgggtgttttagtttatttattgattaagtgagggattgattttaggttataaagtgttgtgtttatgtgatttgagaatatgtgtgtgtagagtgtttttatagtgtttttgtaaagttgagtatgtatatgttttgttagtgtgtaggtagtttgtttatatatgtttaggagtgtgattttatgttttggtagatggggaaggagagagggagttgtgtttagggttttttgattatttttatgggtgtatgtttgtgttttttgttaggggtgtttggggaagattttgttttgggtgttttggattatttgtgtgtgtgtgtgtgtgtgtatgtggggatgtgtatgtgtattagggggtgtattgtgttatagtatttttaattaattttgtatgtgtgtatatgtttgtgtgtgtgtgttttataggtgtgagtgagtggatgtttttattatgtgtttgtatatgtgtgtgtgtatttgtattgtttttgtatatttgtgtgtgttttgtgagagtggagtttagtatgtgttggtatttgtaggaatatgtgagtgtgtgttttgtgggtttttgttttgatggttttttatttgttttgagtgttatgatgatgaggatggggattatatttttggagtttgaggatttaatataggtttagttttgtgtagttgtttgttaagttgttagaggatgagttggatgttgaaggttatgagtggatgattgtagttagtttttaatttgttgattttgtgtttttttattggttttggtttgatgattttggttttggggtgtttttggtttttttttattgtgttgttgtttttttttttggtataatttttagttgtggggttgtagattttaagagttttatgagttttttgtgttttgtttattggttttggttttgatttttnttttagattggattagagaggtgggaagtttgggggtatttgttgtgggtgttttgtttttggggttgggttttggggagttggtgtggtgtttgttttttgtttgttagttttttgggagtttaggtgtgggtagttgtttgtgtttttgggaagggtggagttgtgttttggggagatatgttttgtagttggtagtttagttgttttttgttggttggttgttttgtgagggttttgtangtggnangggttggggttggggtgggtntngnngagnangggggttttgggttggggttggtttggttttttgggtggtgtgtgggttgaagaattaggaggattgttgggttgggttgtttgttttttggaaaaattttggtggttttttttttggtgtttgtggattttgttgtggtgttttttagggttgtggatttttgtttattggttgtgttagttgttttggagtagaaaggatttttttttttttggattgagttttgagttttgagttttatggagtaggtaagtgttggagttttgaggttaaggtttggttggtgggtgttttggtatttttttttgtttttgagggtgtttgtttggtttggttgggattggttgggaaattgaggttggaagaggttgtagtttagtaaggaattggtttgtgtggggtgggggtgggatgggagatttttttttaattttattagttttagtttagttgtggtttttgttgtgttatttagaaaattagtgttaaattttagttttgtttgggatgtggattttgtttggggagagttttgtttaggtttttttagggt

SEQ ID NO: 253 - DNA, 2434 bp, Artificial Sequence
  chemically treated genomic DNA (Homo sapiens)
  unsure (555, 557, 561, 562, 564, 566, 587, 589, 594, 837): unknown base
gttttggaaaagtttgaatgggattttttttaggtaaggtttatattttaggtagggttggggtttgatgttggttttttgagtgatatggtgggggttatagttgggttggggttggtggggttggggaggggttttttattttatttttattttatataaattgattttttgttggattgtgattttttttggttttggttttttagttagttttggttgggttggataggtatttttgggggtgggaaaaggtgttagagtgtttgttggttgggttttagttttgggattttggtgtttgtttgttttatggggtttggggtttggggtttggtttgggaggaggggggttttttttgttttaggatagttggtgtgattggtgggtaaaggtttgtggttttggagaatgttatggtggggtttatggatattagaggaggaattgttaaggtttttttaaaggataagtggtttggtttggtggtttttttagttttttggtttgtgtgttatttgggaggttgaattggttttagtttggggtttttntntttnntnangtttgttttagttttgatttntnttgtntgtggggtttttatggagtggttggttagtggggagtgattaggttgttggttgtaaggtgtgtttttttgggatgtagttttgttttttttaggaatataagtggttgtttgtgtttgagtttttaaagggttggtgggtagggagtgggtgttgtgttggttttttggagtttagttttggaaatgggatatttatagtgggtgtttttaaattttttatttttttggtttggtttggggnaggggttggggttggggttggtgggtagggtgtggagagtttatggagtttttagggtttgtggttttgtggttgggggttatgttaagggagaaagtgatgatgtgatggggagggattgagagtattttgaagttgggattattaagttggagttagtggaggggtgtgaagttggtgagttggaaattaattgtaattgtttatttgtagtttttggtgtttggtttgttttttggtggtttggtgggtggttgtatagggttggatttgtgttggatttttaggttttgaagatatggtttttatttttgttgttgtgatatttgggataagtggagagttattaggatagggatttatagaatgtatatttatatgtttttgtaggtgttagtatatgttgggttttgtttttatgggatatatgtaggtgtgtaaggataatgtaagtgtatatatatatgtgtagatatgtagtggaagtatttatttgtttatatttgtaggatatatatatataaatatatgtatatatatagagttggttgaggatgttgtaatatagtatattttttaatgtatgtgtgtgtttttgtgtgtatatatatatatatatataggtgatttagggtatttagggtagaattttttttaagtatttttaataagaagtataaatatgtatttatagaagtaattgggggattttgggtataattttttttttttttttttatttattaggatatggagttatatttttaggtatgtgtggataggttgtttatatattggtaggatatgtatatgtttaattttataaggatattgtgggaatattttgtgtatatgtatttttaggttatataaatatagtattttgtaatttggagttagttttttatttggttagtgagtgggttgaagtatttattgggataaggtggttgagaattaggatagggtttggttaggaggggttgagggtagggtttgggaagtgagtgatgtaatgaggttgggtatgatggtattggtattattttttatttaattatttattgtaggttttttatataattgggttattaaataaattttagagggtttagttttatttgttgtttggttttttagaaatagaatttggttgggaatggttgttgtttggataggtttgtttttagaaagttttgggtatggatggagttttgtttattttttggtttttattgatatatttatttattaatattttgtttaagttttttttttggagtttttattagaattatttttaatgaagagttatagggagaagatgtttatttatgtatgaggagataggtttggaatagagtttttttgtatagttttagaagggatttattttgttgatattttgattttggatttatggtttttagtattgtgagatagtaatattttgttgttgaaggtgtttagtttgtggtattgtaaaatagttttaggaaattaatatagtttgttagtttatagatggtggagagatggaatgttttatggagttttaggtttattgtttgtagtttttaaagtgtgttatgggatt

SEQ ID NO: 254 - DNA, 2476 bp, Artificial Sequence
  chemically treated genomic DNA (Homo sapiens)
tgattttaggttgataattgtaagtttttaggtagaggggaagttttagtgttgagaagtttgttttgagaattttttgtgttgggtgtttagtttgagtgttttgggtgtggagtttatttttggtgtgggtagggttttagttgtaggtttggtgtagggtggatttggttgaagtttggagggttggaggtgttgggatgtagtttggataagagggtggatttgattttggaaagtttgtgggatttaggtattttaatattgggaagataaagagatttgatttttttgggattggtgaggggagtttggtggggaggggaatggtagggtagttaagtgtgaaagagaattttttgggtttaaagttaatgtagttattttataagttattttagaggtgattggaaaaaataataataataaaggtgtttagtaggttgtggttgggaaggaaaaataatgtttgtaagatgagtgtgttgatttgtagttttatattttttgtttattagttggaatatatatagatttatatatttagtaaatgtaaattttattatttaaagatgtgtttgttttggttataattgttttaagtgtttataggttaattttatatatggaatattttgaaagtgggtgatttgatttttaagtttaattggtttgtgttgtttgttgaattgtaaattttagtaaaatttaaatatattggaattttagttgttttttgggagtgaggaagtgggagtaatgttaaaaggggaaaagaagaatagtaaaaaaagtataaagatattattttttgatgtaaaattatgggattttttttaaatggtataagagaatttttggagaagattattattaattaataagtaataatgttttttagggtttattagatgttttatatttgtttgggaattttgattttttaggttttttgagaaatttatttgtttggaagaagttgtattttgttgttataggagttgttgagagttagggatggagattttagatttaggattttgttatgattttattgatttttaagtgttaatagaatgaaatggatatgtttattagttattataaattgaattattttatatgagagagagaaatgtggtttaagttttatatttgttttttaaataattgattttttttaattttgtttttaaaggtttgtggaaattagggagggggttggggagatggttttagaaataaaatgtttttttttagtatggtttttatatttagtttatttaagttgatttttgtaatttatataaagaatgggtttgggtgggtggttagtgaagattggggtgagtaagtgtttatgttgttgagtgttggggaggtttaggtttgtttttgtatagaattttgtaaggagtgtgttttgttaggtgtttggattagagggtgttgtgtttttgtaaattttgtggttttgatgtgttttttttaggtattattgttataataagttatatttaaaataatgtataaatagtattgttttttaagttttttttaatagtgttttatatgtattttatgaatttttaaagttatgtatatgaattttttattgttgatttgtataaagttagagggatgtgtagtttttggagttgagaatttgtagggtgtatatgtttttttgtatttgtttagagttatatattttatgtaattttattaatgtttaaatttaaatgttaaaaggtatgtatgatttgaataaagaatttattagtttagttgagtttttggttttgggttttaaagtttttggtagttttgtgatttttttgtggtgtagatatgtgttaagagttgggtttgaagtattaattttgtttttttgggatttttagtatgtttttaattagagtgttaatgtttgtgttgttgggatttaggtggttgtatttttggaggtttttgattagggtaaatttaagtattaaatgtaggtgaaaagagagtgtgtggggttggaatgagggtttgggagtagttaagtttgttaggatgtgtttaggtagttagttgttgagttgaggagttgtggttgttggttgtggtgatttgttgtttttttttttatttttttttttttggaggtggtgggggaggggaggtgatgttagtgttttgttttgttttttgttttgggtgtggatgggattttttggttgggtgtgttattttgatagtggtagtagtggttgtggaggttgtgggggttttggtttttgtggtttttttggttggttgtagttgtggtgtgggtgaaatgtttgttttttttttttggttgtgttttttgggtgttggtgagtgtgggtgttttttgtatttagtgtttggagttgtttggagttttgttgtgtgtatttttttggtttgtggagtttttttggtggtgttttttatgttgtggatt

SEQ ID NO: 255 - DNA, 2476 bp, Artificial Sequence
  chemically treated genomic DNA (Homo sapiens)
agtttgtggtgtgggaaatgttgttggaggggttttgtgagttggggaagtgtgtgtagtggggttttaggtggttttaggtgttgagtgtgaggaatgtttgtgtttgttggtgtttgggagatgtagttgaaggaggagggtgggtgttttatttgtgttatagttgtggttggttagagagattgtagaggttgggatttttgtagtttttatggttgttgttgttattgttggggtggtgtgtttagttggagaattttgtttgtgtttggggtggggggtgaggtggggtgttgatgttatttttttttttttattgtttttaagggggagggagtggggaaagaggtagtgagttgttgtagttggtggttgtaattttttaatttggtggttggttgtttgggtatgttttgataaatttggttgtttttgggtttttgttttggttttgtgtattttttttttgtttgtgtttggtgtttaagtttgttttggttggaagtttttggagatgtggttgtttgggttttggtggtatggatgttggtattttggttagggatatgttgaagattttggggaggtaaagttggtattttaaatttggtttttaatatatatttatattgtgaggggattatggagttgttgaggattttagagtttagggttgaggatttggttagattggtgagttttttgtttaaattgtgtatgttttttggtatttaagtttaaatgttaatgaaattatgtggggtgtgtggttttaagtgagtgtggggaagtgtgtgtgttttatgggtttttggttttaggagttgtgtatttttttggttttgtgtggattggtgatgaaagatttgtatgtatagttttgggagtttataaaatatatatagagtattgttaaaaagaatttgagaggtgatgttgtttgtgtattattttgaatgtaatttattatagtaatggtgtttagggagggtgtattggggttgtgagatttgtaggggtgtagtgttttttagtttgggtatttggtgaggtgtgttttttgtagggttttgtgtggaggtgaatttggatttttttggtgtttggtgatgtgggtgtttgtttattttagtttttattgattatttatttgggtttattttttatatgagttataaaaattagtttgggtggattggatgtagaggttgtgttggaggaaagtgttttgtttttggaattgtttttttaattttttttttaatttttatgagtttttggggatagggttagggagggttgattatttaaaggataaatgtggaatttgaattatattttttttttttatataaaataatttgatttgtggtagttaataggtatgtttattttgttttgttggtgtttaaggattagtagaattgtggtagagttttaagtttgaaatttttatttttggtttttggtggtttttgtggtgatgaagtgtaattttttttaggtagatagattttttagggagtttggaaaattgggatttttagatagatgtaaaatatttagtaagttttaggaagtgttattatttattaattaatggtaattttttttaggaatttttttgtgttatttaaaaaaaattttgtgattttatgttagggaatggtatttttgtattttttttattgttttttttttttttttttagtattatttttgtttttttgtttttaggaaatggttggagttttggtgtgtttgggttttgttgagatttataatttggtaagtggtataagttggttgggtttggagattaggttatttatttttgaggtgttttatgtatgaaattgatttgtaagtatttggagtaattatggttgggataaatatgtttttggatgatggagtttgtatttgttggatgtgtgaatttatgtgtattttaattggtgggtagggaatatagggttatgaattggtatatttattttgtaggtattattttttttttttagttataatttgttagatatttttattattattattttttttggttatttttaagatggtttataaggtgattgtgttaattttgaatttaggaaatttttttttatatttgattgttttgttgtttttttttttgttaagttttttttattagttttagggaaattggatttttttgtttttttagtgttaaaatgtttgagttttataaattttttgagattaagtttgtttttttgtttgggttgtgttttagtgtttttggttttttgggttttggttgagtttgttttgtgttgagtttgtggttggagttttgtttgtattggggatgggttttgtgtttgggatgtttaggttgggtgtttggtgtggggagtttttggagtgggttttttggtgttggggttttttttttgtttaggaatttgtagttgttggtttggggtta

SEQ ID NO: 256 - DNA, 2520 bp, Artificial Sequence
  chemically treated genomic DNA (Homo sapiens)
gtttttggtgtgtagtgatttagagattgtttatgaggttatttaggatgtgtatggtttgttgtgggaggagagtggggaataggggtggtgtgttggggattgtgtttgtatggagttggggtgtgaggagatttgttttgtttagtgttgggtatgatgtttatttttgtttgaagatttggaatgagttttttttttttaattgtgaaatgggagtggtgtaagtttttagttttttatttgtgatttttaagttttaaagttgtttggaagtttagaagttttttgtaatttaattggtggtaaaattgtgtttgaattgatgtgaggttgttgatggtttttatttgttaaatttgtgtgaatatttatgttttgttgtagaaatgtaaatgagtttgatgattggttgttgttttaagttttgttgggaggttatgtgatttatagtaggtgtgtgttttatagtttttttttaagttttagttgttttgtattttgaagtgtatttgggtatggaatgggggattgtgggtttgttgttggtttaatagttttgttagttttttaggagtttggggttagatgagagggtggatgtgaaatttaggtgtttgtttttttttgagggtgtttttaatattttagatgggtttgtttgggtgtttttaatattgatgggtttgttttagaaaggtgtttggttatggtgaggttgttttttttttttttttagaatttggttgtgttaattagggaaattgaaaataaagtatgttttaaaaatatgtttatatttttagaatattttgggtgattttgatattttgaattttaggaattttttaaggaggggtagtttgagtgggaaaaagagatgtttagaattgtttttttatttgttattagttgtgtgatgatttaggggtagtttttttttttttttagggttttggtttgttttttagtttaaagggaggggatggatagatgattgttgaattttgggagtttttgattttttttgttgtgtttgatgttattattatgaatattgatgtttattatgtgttaggattgagtttgggatgtttaaatgaagagatatgtttttgtaggtttgttgttggatgttttttttgtttgatttgttataatgtagagtttaggttttgagattagggaaagggtaattggattttgttgggttatttgttagttgttgatagttatttaatttatatgtgaggatgtttttttaggtttagtgttttttggtgtaagtataatatttaaggattagggttgtgagttttaaatgaggtaaggtttttaagtatttggtagtagtagggggtttatttagattgtttgggttgttttggtttggtttttttaggattgtgttgtttttatttgagtttttgtagtggtagtttgttgttttgtggttagggtggaaaatggtatttggtggatagggtaggagattatggttgttttttgttttgtgtttttgttagttagtaggtagtttttttgggatggatggttggatgttagtgttttttttttgtagtgtttttttgttttttgtttaggtttttggtggtgtattttttggtttttttatattttttgttttgtaggagggtttttgtttgtttgagtggagtttttggaggtgggggaatggttttattttttgaattttgtatttggtttagggtttggtttagatagagtgtatagagtgtgtgttgaggagggtgtaggtgtggtagttttttatttatgagttaggtttttgtaggtttgtttaagggttattattaggttttaggattaaagaggaaggagattgtttaggttttgatattttttgagaagatagatgattttggttgttagggtgtttgttaggtggtttttttgtttattttttttttagtttttagtaggtttttagttgtagtggtatatggggggaggggtataggtgatgagggtaggggatttatttggggggaattaggatattggttagagataggttgttttttggttttatttgtggttttaatttattgtgtgatttttataagttattttgtatttttggttttgttttttattttgtgtaatgtgttgttgtattttagtttggatgatagagtaagatttttttttttaaaaaaaaaattttaatttagttttaatttattttttgaggagagttatgtatttggtaattttggtattgttgtatgtaagagaaaattagaaaggaagtgatagaggtttttaaaatattgttatataaatgagttattaattgaatttttataattggttaatgagttttagtatttagaattattgaattttatagagatgaattgtttttttaaaagattatgtgtttttaaatttatgtttaatgagttgattattttatgagggtgttaggtgatatagtgaagattatatatgtatagagtgatagaatgttggtag

SEQ ID NO: 257 - DNA, 2520 bp, Artificial Sequence
  chemically treated genomic DNA (Homo sapiens)
ttgttagtgttttattattttgtgtatatgtggtttttattatgttatttggtatttttatgaaataattggtttattgaatatgagtttaaaaatatatgattttttaaaagagtagtttatttttatagaatttggtgattttaaatattaaagtttattagttagttgtaaaaatttaattaatagtttatttatgtgatagtgttttggaagtttttattattttttttttggtttttttttatatgtaataatgttaaggttattagatatatgattttttttgagaagtgaattagaattgaattaagattttttttttaagagagagaattttgttttgttatttaggttggagtgtaatagtatattgtatagggtaggaaataggattagagatgtaaagtgatttgtggaggttatatagtgaattagggttataagtggggttaaggagtagtttgtttttggttaatgttttagttttttttgggtaagttttttgtttttattatttgtgtttttttttttatatgttattgtaattgggaatttgttgggagttggaggaaggatgggtagaggggttatttggtaggtgttttggtagttagggttatttgtttttttaggagatgttaggatttgggtagttttttttttttttggttttggggtttggtggtggtttttgggtagatttatagaggtttggtttataggtaaggggttgttgtatttgtgttttttttagtatatattttgtgtattttgtttgagttagattttgggttggatgtgaggtttaaagaataaggttatttttttatttttaggggttttgtttagatgggtaggaatttttttataggatagagaatgtggagaggttgggaagtgtgttattgggagtttgggtaggaaatggaggggtgttgtgggggaagagtgttggtatttagttatttattttagagaagttgtttgttggttggtaggggtgtgaaataggaaatagttgtggttttttgttttgtttgttgggtgttgttttttattttggttataaggtggtgggttgttgttgtaggagtttgagtgaaagtggtatagttttaaggaagttaaattaggatgatttggatagtttgggtggattttttgttgttgttaagtgtttagaagttttattttgtttagggtttataattttaatttttaggtattgtgtttatattagaggatgttgggtttgggggagtgtttttgtgtgtaagttaagtggttgttagtaattggtaggtgatttagtagagtttagttgttttttttttagttttgaaatttgagttttgtattgtaatgagttgagtggagggaatatttagtagtgggtttatggaggtgtgtttttttgtttgggtattttggatttagttttggtatatggtgggtattagtgtttatggtaatgatattaggtatagtgaaagaaattagaggtttttaaggtttagtggttatttgtttattttttttttttgggttaaagaataaattgagattttgagagaggaagggaattgtttttagattattatatagttggtggtagatgaaagaatggttttgagtattttttttttttatttgggttgtttttttttgaaaagtttttaaagtttaaaatgttagggttgtttagagtgttttgaggatgtaagtgtgtttttaaaatgtgttttatttttgatttttttgattaatataattggattttgaagagagaaaaaaaataattttattataattggatgtttttttgaaataaatttattaatgttggaagtatttaaataaatttatttgaaatgttggaagtatttttaaagggaagtagatgtttgagttttatatttatttttttatttgattttaggtttttgggagattggtaaggttgttgagttggtggtaagtttgtaattttttgttttgtgtttagatgtgttttggaatatagaatagttgggatttggaaagagattatggggtatatatttgttgtaggttatataattttttagtagggtttggggtagtagttggttattgagtttatttgtatttttgtagtaaaatatgaatatttatataagtttgataaataaagattattaatagttttatattagtttaagtgtaattttgttattaattggattatgaaaaatttttgggtttttaggtagttttggagtttgggaattgtagatgagggattaggggtttgtattgtttttgttttgtggttggggagagggagtttattttaagtttttagatagaggtgggtattgtgtttgatgttgagtggagtaggtttttttgtgttttggttttgtgtgggtgtggtttttagtgtgttatttttgttttttgttttttttttgtggtgggttgtgtatattttggatggttttgtagatggtttttgagttgttgtgtgttaggggt

SEQ ID NO: 258 - DNA, 2555 bp, Artificial Sequence
  chemically treated genomic DNA (Homo sapiens)
aggatagaaatgagttgggaatttgggtagtttattattttttgtatttatagaggtgggattgtggattttggttgggtagatattttagaggagtttgatagttttttagatgtggatagtaagtgtttattgtggtattggtttttttgtgtttttgggtttagagtttttttttttttttttttttttttttgtaggaagttttattatttaaaattgtttgtttaataattattattaagatgttatttttgagggagtatatatagtaggtgtttaataaatatttaataaatgaaggtattttttgaatgatttatttatttagtaaggagtttttgggtatttattttgtattaggtatttaattaggttttggagagaggaaatttaaggagtttaggtttaatgagattgatgtatatgttagttatttaataaaaagtggtgtgtgtagtggaagaaggtgtttgggagtaaagaggaggtagtttttattttagttgagttttttagttaaggggttggggtttgtaagtatagggagtagtgtgtgtgggagttaggggtttttagaaattgtttagaaatttgtgagggggttaggatgaagtttagagttagatatttatgtttagtaagttagttggtttataatttgttttttttttgtatgaatttttaagggggtgtagatggagagtgttagtgattttgtgttttttataggttgagtttaaatttttggggttatgaatggggtttgagaagttttgggggtgggattggtttatgtagatttttgtttttgtttttgtatttgttagttagagttagggttttagggtttgtgggggggattataaaatatatggttggagtaattagtttgtttttagtgttgtttatgagtttttagttttttttgttgtttttttgtagggtgtagttgtagttttgtgagattaggttttggtgggggtaggttggatagttaggattttggtagggtttgagggtttgggagtttggttgttattttagtttttgatttttggatttggggagttttggtttattatttggattttttttgtagagtggggaggggtatgtaggagaagtatatgtgttgaggttgttggtttagtaatttatttttatttttttttggggaatttttttttttaatttttagtttttgtggtttttttttttttatttttaagttttagatggatatgtgatttggatttggttaatgattggtatttgttagttatagttattggtatagggtggattttggtattttttggttatagtgattggtgtaggatggatatgtgatttatagtgagttaatgagaatttggtttgggatttttgaggagggattggggttgttaagttggtggaatataaggttagggtagttgaggtgggggtggtataggggtgttagttggtttgtattaggggaagggttggtagagtgatattaattatggagataggtataggtttttgagaatggtgtttgaggtttgggatttaattatgttattttaaaaattttgtagtgatgtgaatagaggagttggttttatgtatttgtttttttttaaagttatagagtgtttttatggggatgggtttgagtggagttttttggtggtatttgaggggtattatttgttggttttgtttttgtagtttttgtattatgtttttatatttgtttagtatttttttttggttttggagagaatggggttaggggtttaggtgagattaatagttttttttttggtgggaggatgtagagtaggggttggatttagtaggtggggtgttgtggaggggtttgtatagggttgagggtaggtatggtgtagaggggttttttgttttttgggttagtaggggttttgggttattgtttatatttagtttttgtagtagtagtttaatttggtattggtttttgaagttagggttatatttttggtttaggtttgagtttattttgtgtagtagtttttgagtgttttttatgtttttgtgaaattaggggagaaggtggttttgttatagttaggaaattattagaagtatttgggtttttgttggaggttttaagtttattttttaggtggggttgggtttttggtttatttggagtttagtatgggattttgtgttgagtttgaggtttttttgtgtggagatagttttattttttttgagttggttttttaggggttttattgggaaaagttaggtttttttttatttatttatgagatgttatttttgtgatatgtttttttggatgtattagtaagttttgaggtgtttttgatttagtttttttttttgtattaggaatatttagatttaatattatagtttttttttaggttttgataatagttttttttttttgtttttgaaaatttttttgtttattttttagtttattaatttttggtttattgttagttattttttgggttgagtatttgggttgtagttataaataggatttg

SEQ ID NO: 259 - DNA, 2555 bp, Artificial Sequence
  chemically treated genomic DNA (Homo sapiens)
taggttttgtttatggttgtagtttaggtgtttagtttaggggatagttgatagtgaattaagagttgatagattgaagaatgggtaagagaatttttgagaataaaaaggggaggttattattaaaatttagaaagaagttatagtattaagtttggatgtttttagtatagagagaggaattgaattaaagatattttaagatttattgatatatttaagaaaatatgttatagaggtggtattttatggatgggtgggaagggatttggttttttttagtgaggtttttaaggagttagtttagggagggtggggttgtttttatgtagaggagttttaggtttagtatagggttttatgttggattttaggtgaattggaggtttagttttgtttgagggatgagtttgaagtttttgatagaagtttaggtgtttttagtggttttttggttgtaatagagttatttttttttttagttttatgaagatgtgaaggatgtttaggagttgttgtgtaaggtggatttggatttgaattagaagtatggttttgattttaaggattggtattagattgagttgttgttgtgggagttggatgtgagtgatggtttaggatttttgttggtttggggggtgggggatttttttatattatgtttgtttttagttttgtataggtttttttatagtattttatttgttgaatttagtttttgttttgtgtttttttattagggggaaggttgttggttttatttgggtttttgattttgttttttttaggattaggagaaggtgttggataagtatgaggatgtggtgtaggggttgtagaagtgaggttagtaggtggtgttttttaagtattgttgggagattttgtttaagtttatttttgtggaggtattttgtgattttgagggggagtaggtgtgtggggttagtttttttgtttatattattataaagtttttggggtaatatggttggattttgggttttaggtgttgtttttaggagtttgtgtttgtttttgtggttggtgttattttgttaattttttttttggtgtaggttaattggtatttttatgttgtttttattttggttgttttggttttgtgttttattagtttagtaattttagtttttttttagaagttttaggttaggtttttattggtttattgtgagttatgtgtttattttatattaattattgtggttagggaatgttagggtttattttatattaatgattgtggttggtgaatgttagttattggttaggtttaagttatatgtttatttggagtttgggaatggagaaggagagattatagggattgggaattgggagggaaggttttttaaagggaaatggaggtgggttgttgggttggtagttttaatatatgtgttttttttgtatgtttttttttattttatggggagggtttaagtgatgagttggggttttttaggtttaagagttgggggttgagatggtaattgggtttttaggtttttaggttttgttgggattttgattgtttagtttgtttttgttagggtttgattttgtggggttatagttatattttgtagaagaataatggggagagttgggagtttatggatagtgttgggaataagttgattgttttggttgtgtgttttgtgattttttttatagattttgaggttttggttttggttgataggtataagggtaaaggtgggagtttgtatggattagttttatttttagggttttttaggttttatttatagttttggggatttggatttagtttgtggggagtgtggggttgttgatattttttatttgtatttttttggaagtttatgtaggagaggggtagattgtgggttagttgatttgttaaatatgaatgtttagttttgggttttgttttggtttttttatgagtttttaagtagtttttaagggtttttgatttttgtatgtattgttttttgtatttgtagattttagttttttggttggaggatttagttgggataagggttgttttttttttgtttttaggtatttttttttattgtatgtattgttttttattaagtgattagtgtatgtgttagttttattgggtttgggttttttgaattttttttttttagggtttagttaagtatttggtataaagtaggtgtttaggaattttttgttgaatgagtggattatttaaggaatgtttttatttattaagtatttattgagtatttattgtgtatgtttttttagaagtaatattttggtggtgattattggatagataattttaggtagtgagattttttatgaaagaggagggaaggagggagaagagttttgagtttaggagtatagaaaggttagtgttatagtgagtatttgttgtttgtatttaaggagttgttaggtttttttggggtgtttgtttagttagagtttgtagttttgtttttgtgggtgtagggggtggtgggttgtttaggtttttagtttatttttgtttt

SEQ ID NO: 260 - DNA, 2516 bp, Artificial Sequence
  chemically treated genomic DNA (Homo sapiens)
tttaataaaatatttgtaaattaaatttagtagtttattaaaaagtgaatttattataattaagtaggttttaattttaggatgtaagtttggtttaatatatgtaaattaataaatgtgatttattatataaaattaaagataaaagttatattattattttaatggatgtataagaggtttttgataaaatttaatattttttattaaaaatttttaataaattaggtattaaagaaatatattttaatatatatgtgataaatttatagttaatgttatattaaatgggtaaatgttggaaatattttttttgaaaattagtataagataagggtgtttttttttattatttttatttaatatagtattgtaagttttggttagggtaattaagaaagaataaaatgaagggtatttaaataggaagagaggaagttaaattatttttgtttgtagatgatgtgattttgtatttagaaaattttatagttttggtttaaaagtttttttaggtgataaataattttagtaaagttttgggatataagattaatgtaaaaaattattggtatttttatatgttaataatggttaagtttagagttaaattaggaatgaaattttatttatgattgttataaaaagaataaaatgtttaggaatatagttaattagggaggtgaaagatttttataatgagaattgtaaaaatattatttaaagaaattagagatgttagtagttagtttagtttgtttgtttgtttgtagttgtttgttagatatgtttagtatgagggagattttgtatatttaggttggttagtgtggtaattagattggggttaagttttgggaagttattagtgatgagtatggtatagattttagtggtaattatgtggggaatttggatttggagttggagtagattagtatttattataatgaggtttttttttataagtatgtgttttgggttatttgttgatttggagtttgggattatggatagtgttggtttggggttttttggatatttttttaggtttgataatttaatttttggttagagtggggttggtaataattgggttaggggttattatatggagggtgtggagttggtggatttttttttggatgtgtggaagaagtgtgagaattgtgatggtttgtagggtttttagttgatttttttgttgggtgggggtataagtttgggtatgggtatgttgtttattagtaagatgtatgaggagtattttaattgtattatgaatatttttagtgtagtgtttttgtttaaggtgttattgtggtggagttttataattttatgttgtttatttattagttggtggagaatatagatgagatttattgtattaataaggaggtgttttaggatatttgtgttagtatttttaggttggttatgtttatttatggggattttagttatttgatattggttattatgagtaggattattatttttttgtgttttttgggttagtttaatgtggatttgtataagttggtggtgaatatgggtgttttttttttgtttgtatttttttatgttaggtatgaagtttgggtagttagtattattgggttttgattgtgtttgagtttattttttagatgtttgatgttaagaatatgatggttgtttgtgattggtattatggttgttatttggtagtggttattgtgttttggggttgtttgtttatgaaggaggtggatgagtagatgttgtttatttagagtaagaatagtagttattttgtggagtggatttttaataatatgaaggtggatgtgtgtgatattttattttttagttttaagatgttttttatttttattagtaatagtatgggtatttaggagttgtttaagtattttagagtagtttatggatatgttttagtataaggtttttttatattggtatatgggtaagggtatggatgagatggagattattgaggttaagagtaatatgaatgatttggtgtttgagtattagtagtattaggattttatggtttaggaggagggtgagatgtttgtagatgaggaggaggaattggaggtttagggttttaagtgaagttgtttgtagttggagtgaggggtaggtggtgttggtgttaaggttagtagtgtttgatttttagagttattttgttgttgatattgtttttagtttttttttattagtttgttatttatgttagggtttttttgttatttttttgtagtgtttatatttgttttttttatttaggttatgtgtgtgttgtttttgtttttgttttattgtagttttaggtttgatattttatggatttgttttttattggtttgtgtttatatttttagggatatttaataaatttattgttgttagataaaaaaaaaaagaaattagagatgatataaagaaatgaaaatatattttatgtttatggataggaagatttaatattattaaaatgg

SEQ ID NO: 261 - DNA, 2516 bp, Artificial Sequence
  chemically treated genomic DNA (Homo sapiens)
ttattttaatgatattgagtttttttatttatgagtatgaaatgtatttttatttttttgtgttatttttgatttttttttttttttatttgatagtaatagatttattaagtatttttgaaaatataaatataaattagtaaaaaataaatttataaaatgttaggtttggagttgtaataagatagagataggagtagtatatatgtggtttaggtggggaggatgggtgtaaatattgtaggagggtggtaagggagttttagtgtgagtgataagttggtgggggaaagttggggatagtgttgatagtaagatggttttggaggttagatattgttggttttggtattggtgttatttgttttttattttagttgtaagtagttttatttggggttttgggtttttaattttttttttttatttgtgaatattttattttttttttgggttatggagttttggtattgttggtatttggatattaggttatttatgttgtttttggttttggtgatttttattttgtttatgtttttgtttatgtattagtgtaggaaggttttgtgttggaatatgtttgtgaattgttttgagatgtttgaatagtttttggatgtttgtgttgttgttgatgagggtggaagatattttgaggttggggggtgggatgttatatatgtttatttttatgttgttggggatttattttatgaagtagttgttgtttttgttttggatggatagtatttgtttgtttattttttttatggataggtagttttggaatatggtggttattgttaggtagtagttgtggtgttggttgtgggtagttattatgtttttggtattaaatatttgaggggtgagtttgggtatggttagggtttggtaatgttggttgtttgggttttatgtttggtatgaagaagtgtaggtaggggaagggtatttatgtttattattagtttgtgtaggtttgtattgagttggtttgggaagtataaggaggtagtgattttgtttatggtggttaatgttaggtggttgaggtttttgtaggtgggtgtggttagtttgagggtgttgatgtagatgttttagagtgtttttttgttgatgtagtaggttttatttgtattttttattagttggtggatggatagtatggggttgtagggttttattatagtgatattttgggtgagggtattatgttgaaggtgtttatgatgtagttgggatattttttatgtattttgttgatgagtagtgtgtttatatttgagtttgtgtttttgtttagtgagagggttagttggaaattttatagattgttgtagtttttatattttttttgtatatttaggagggaatttattagttttgtattttttgtgtagtgatttttggtttagttattgttggttttattttgattaaagattaaattgttaggtttgaaaaaatgtttaaaaggttttgagttgatattgtttatggttttgggttttaggttgatgaatggtttgaggtatatatttatgagaagaggttttgttgtagtagatgttgatttgttttagttttaagtttgagttttttatgtagttgttgttggggtttatgttatgtttattattgatgattttttagaatttggttttgatttagttgttgtattggttggtttgaatgtgtaggattttttttatattgggtgtgtttggtaggtggttgtggatgggtaggtgggttgggttggttgttgatatttttgatttttttgagtggtgtttttgtaatttttattgtagagattttttatttttttggttagttgtatttttaggtattttattttttttgtggtaattatgaatgggattttatttttgatttggttttaggtttgattattgttggtatataggaatgttagtgattttttatattgattttgtattttaaaattttgttgaagttgtttattatttgaaggagtttttgggttaaaattatggggttttttagatatagaattatattatttgtaaataagaatagtttgattttttttttttttatttggatgttttttattttgtttttttttgattgttttggttaggatttataatattatgttgaataggagtggtgagagagggtatttttgttttgtgttggtttttaaggggaatgtttttagtatttgtttatttagtatgatgttggttatgggtttgttatatatgtattgaagtgtgtttttttaatatttagtttattaagagtttttaataaggagtgttgaattttattgaaagttttttgtgtatttattgagataataatgtggtttttgtttttagttttatgtgatgaattatatttattgatttgtgtatgttaaattaaatttgtattttgggattgaagtttatttgattgtggtggatttattttttggtgggttgttggatttggtttgtaaatattttgttgag

SEQ ID NO: 262 - DNA, 2364 bp, Artificial Sequence
  chemically treated genomic DNA (Homo sapiens)
gtaaagttggtattgttaaatagtagaggaagtatggtgtgtttaagaagtggttttgggattattagagatttttatagaaaaaaaaatgatatggatttttattttatttataagttgtaagagttaagtttaggtgtgttataggttgaaatataaatgttaaaggtttataaggtagtttttatggtagggtaagagttttttatttttttgttggttttttgttttgttttgagatggagttttaatttgttattgaggatggagtgtagtggtattgtgttagtttattgtaatttttgttttttgggtttaagtaatttttttgttttagttttttgagtagttgggattataggtgtttattattatgtttagttagtttttatatttttagtagagatgggggttttattatgttagttaggttggttttaaatttttgattttaggtgatttatttgttttggttttttaaagtgttgggattataggtgtgagttattatgtttggtttagatttttgaaatgttaataatattgataatttggttataaaattttaaaaatttttgtgtatttataaataaaaaaaattgaaaagttatagaatggaagatatttatattttttgtatattgttttttaaaaatgtattttttataaattaggaaaagatgatttaggagaaaaataggtaaaaagtttttatagatattttataggaggaaattttgtgattaaaaaaagatgtaaataggttttatttttgttgttattaagaaattgttaattggttgggtgtggtggtttatatttgtaattttagtattttgggaggttgaggtgggtggattatgaggttaggagtttaagattagttaggttaatatagtgaaatgttgtttttattaaaaatataaaaattagttgggtatggtggtgtgtatttgtaattttagtaatttaggaggttgaggtaggagaagtatttgaatttgggaggtggaggttgtagtgagttgagattgtgttattgtattttagtttgggtgatagagtgagattgttttaaaaaaaaaaatgttaattgaaggtattgggtagtgtgtggtgtgttttaaatgttaatgttatatagaggagttttagtttggtatgtttgttgtttataaaaggagaggtgttttgtttttttgattatttaaagaagttttatgaattaataggaaaaaagtttatttaattaatataattttattaaaagtgggttagggaagtgaatggaaattttttagaagtagtagtgtgttaggtttatttttatttgaaaatataagttaatttttttagtgtttgggaaaggaatagagaaagtagtgataatttatattatatttattagtttaggaaaagtttaattttggggttttgagaattttatatgggtttagtatattttagtttttggtttgtgtttttaggatataggtttggggttggagataggtttagtagtgtagtggtggtgttgggaggggtttgggatagggtaagttttgggtagatatttttttatttgttgagatttgagtatgtttaggtttgttttataagttatgtggggaggattttgagttatttttaggttgttgattttattttagttgggtagatagtttttttttttttgttatttttttaaatagttgttttatttttgtgagttttattgaggtttagatatatatttttattagtgttgtatatattttaatatttttgaaagtagattattttaatattaatagtgtggtatagtttgatgggtagtattttttggtggtataaaatgatgatgtattttaaaatgaaggatattttagattttgtgaaatattaagttgttagtggatgttgttatttttatttgtttgtgtattggttggtttgtaagttttaggtgggtagggttggtaagtattggtgtaaggtgtatttgtttatgtggtgattttggtgtggggtgtagggtgtggaggtgggtgtagtgtttggagatattaatagttatgtgttgtggggaaggggtagggtagggtgggtagttttttgttttgtttttttttgtgtatttttgaattttttgtatagttgatatttttaaggaaagtatatatatatagtaagggttgtgtatgtaattaatttatttttagtgtagggtaaggaaattaattttaaaggagagattgtagtttagagttttttgtagggtatttatttggatatgttttgggaagaggggtattggtttttattatagttttagttaggtttgtgggaaattttttttatttt

SEQ ID NO: 263 - DNA, 2364 bp, Artificial Sequence
  chemically treated genomic DNA (Homo sapiens)
ggggtgaggagggttttttataagtttggttggggttgtggtgggggttggtgtttttttttttggaatatatttaggtgggtgttttgtaggaagttttgggttgtagttttttttttggagttaatttttttgttttgtattggaagtgaattgattgtatatatagtttttgttatatatatatgttttttttgaaagtattagttgtgtaaagagtttagaaatgtataggagagaatagaatagaaaattgtttattttgttttgttttttttttatagtatatggttgttggtatttttggatattatgtttatttttatattttgtattttatattggagttattgtgtaagtaggtgtattttgtgttagtgtttattagttttgtttgtttggagtttataggttggttagtgtataggtagatgaggatagtagtatttattgataatttggtattttatggaatttaaggtgttttttattttaagatatattattattttgtgttattaagaaatgttgtttattaaattatgttatgttgttgatgttaagatggtttgtttttaaagatgttgaagtgtgtatggtattgatgggggtgtatgtttgggttttagtggagtttatgggggtggggtggttatttgagaaagtggtaggaggagaggagttgtttgtttagttggggtggagttgatggtttgaggatgatttggggttttttttgtatggtttatggagtaagtttggatgtgtttgggttttagtaggtgggggagtatttgtttagagtttgttttgttttaggttttttttggtattgttattgtgttgttaagtttgtttttagttttaggtttgtgttttgggagtatgggttgggggttgggatgtgttgggtttgtgtgggatttttagggttttaggattggattttttttggattggtgggtgtgatgtgggttgttattgttttttttgttttttttttgggtattagggaggttgatttgtgtttttaaatggggatgggtttaatatgttgttgtttttgggagatttttgtttatttttttggtttatttttaatgaggttgtgttaattgggtgggttttttttttgttgatttatagaatttttttgagtgattaagaggatagggtgtttttttttttgtgagtagtagatgtgttaagttggggtttttttgtgtggtgttggtatttgagatatattatatgttgtttagtgtttttgattggtatttttttttttaagatagttttattttgttatttaggttggagtgtagtggtatgattttggtttattgtaatttttattttttgggtttaagtgttttttttgttttagttttttgagttgttgggattataggtgtatgttattatgtttggttaatttttgtatttttagtagagatagtattttattatgttggtttggttggttttgaatttttgattttgtgatttatttattttggttttttaaagtgttgggattataggtgtgagttattgtgtttagttgattggtagttttttgatggtaatagaagtggagtttatttatatttttttttggttatggagtttttttttgtgaagtgtttgtagaagttttttgtttgttttttttttgagttatttttttttaatttatagaagatatatttttgaaagataatatatagaaggtataaatattttttattttgtgattttttaattttttttgtttgtggatatatagaagtttttaagattttgtggttagattgttaatgttattagtgttttagaaatttaagttgggtgtggtggtttatgtttgtaattttagtattttgggaggttgaggtgggtggattatttgaggttaggagtttgagattagtttggttaatatggtgaaatttttatttttattaaaaatataaaaattagttgggtgtggtggtgggtgtttgtaattttagttatttaggaggttgaggtaggagaattgtttgaatttaggagatggaggttgtagtgagttgatatagtgttattgtattttatttttggtgatagattaagattttattttaaaataaaataaaaaattaataaaaaaataaaaaatttttgttttgttatggaaattattttgtaaatttttgatgtttgtattttagtttataatgtatttggatttggtttttatggtttgtgaatgaggtggaagtttgtattatttttttttttatgagaatttttaatggttttagagttattttttggatatgttatattttttttgttgtttggtagtgttagttttgt

SEQ ID NO: 264 - DNA, 2408 bp, Artificial Sequence
  chemically treated genomic DNA (Homo sapiens)
atatatgggaggtagaatttagagattgggtttaggagtttttttgttgatagtgggaatttttagttatgtgtgggggtttttatattagataaaggtttttgattttagttttgtttgagaggttgatatagtttagttttggggtttggttttatttataagaggttatattttgttatagtattgtttatttggtttgttttagaagtattgttagagtggtgaaggtaggaggtggtgtatgagagtttatgttttagtatttatttaagtgagggaaaggtgttttgtatttagaaaaatgtaaaattaatgatttttatttatatatgagattgtggatttatttatgtatgagatagtggatttagagttatgttgtggtttttatttgttgggagttagtagtgtttgtgttttggttttgtttttttagttatatggtttatgtgaggtgtggatttatttgagttgttttgtttttatagggagtttgttttttttttgttggtttgtttttatttttgttgtttttgtttagaagaaaatattagaattggggtgtggtggaaggatgggagtataatttgggaggggaagatttgttttttttttatatattaggagggagtggtaggaaggggagatattgtgttggatttagggagttaagagtgtgagtatttttaggttttaatttgttgaatgttgtgtatttgggggtgtttgtgtagtaggaatattttttttattataatttttttgggtatagtggagagttatgagtgggggttgttttgggggttgtgttatggtgagtgagtttatgttaggagttagtttagtttagttttattttttttttgtttttttgttttttaagttttagtttataagtaattagtatagtatttggaatgtaagaggtgtttggtttataaaagagagaagaaaggaattttttttattatgagggatgttaggtttagttttttgttttgggtatttattttttttttggtaattagttttagttttaatgatttgttgtttgttttatgttgtatttatgatttttagattgtaaagtttgtggtaaatgtattaatgtttatattttatttatagattagtaaattaaggatttgagaggttatgtgatttttttagtttggtggagggtagggttttgttagaagttgagatatattttgtaatagtttgttatttggggttttttattagtgaggtaggagttataatggggttttggtttttgggtaatttttataaaatattgtgttatttgaagatggaagtgttagaggaaggtgagatgttatttttgaaagtatttatttttagaaagagatagaggagtgtattgtagttgtgtgaatttggggtggtggtggttttagtagtggggtatgtggtggatgtaagatggttttgtttgagttttgttgttaggtgatatgtagaatttgaattttagagggtgttttttggaggttttgatgagagagatatagaagggaagggagattgtttttatggttttgtttttgtggtagtgagtttgttgtttttgtagttgggtggttgtttggtgtagggggttggtgaggaatatggtggggagtagtttgtgagggtgttgggtttttagtatttattatatttgttgtttggtttggttaggatggtttgggagtttttagggttgggtaaagattgtttttaatagatatgggtggagggaattgttttatttttgtttttttttttttttttatgtagtgttagtgggatgggagggtggtttgtttggggttttaagtttttgtttaggaattggatttatgttgtatgttagtgtagttatatggttagttttgaggtgtttatggatgtttttaggtgtgagatgggtatttttttgtggttattatgtttgttgagtttatttttaaatttgtttttttttaaattaaattttttattttaagtgttttgaatgaagtaaattaattaattaaaaaaatatattttaggattggttagagtttgtgaagatttttataataaatttttgttataagggtttttagagagttttggttgtgtattaaattttgtgatggtaaatttaaagtttaggttttgaggagtttttggagtttgttttttgttttagagatggtttgtgtgagggtgttgttttttttttgttttgattataaggaaggtgatagttgttggggatggtaggtatttttttttagggttataagttgggttgtaggataaaagattgggtggttaatgtttaatttttggtattttaagtggtttgggagtgtgagttggttattgtgggtttgtagatgaattggggagtg

SEQ ID NO: 265 - DNA, 2408 bp, Artificial Sequence
  chemically treated genomic DNA (Homo sapiens)
tattttttagtttatttgtaggtttataatggttggtttatatttttaggttgtttaaaatgttagaggttaaatattagttgtttagttttttattttgtagtttagtttgtggttttgagggagagtgtttattgtttttagtagttgttattttttttatgattaaagtgggaggagagtggtatttttgtatagattatttttgaagtgaggggtagattttaagagttttttagagtttgagttttgggtttgttattgtggggtttaatgtataattagggttttttgaaaatttttgtaatggggatttgttatggaaatttttatagattttggttaattttggaatatatttttttaattggttgatttgttttgtttaaagtgtttagaatggaagatttagtttgaggaggggtaggtttgggggtaggtttagtgggtatagtggttataagaagatgtttattttatatttggagatgtttatgagtattttgaagttggttgtgtggttgtattggtgtatgatatgggtttggtttttggataggagtttgaagttttgggtagattatttttttgttttattgatattgtgtagagaagggagaagaggtaggggtgagatggttttttttgtttatgtttgttgggggtagtttttgtttggttttggggatttttaggttattttggttaaattaaatagtaggtatagtgagtgttgaaagtttggtgtttttgtaggttgttttttattgtgttttttattggttttttgtattgaatagttatttagttgtaagagtagtaggtttgttgttgtagaggtaggattatgggaatagtttttttttttttttgtgttttttttattagggtttttaaggagtattttttgaagtttaagttttatatgttatttagtagtaaaatttaaatggggttgttttgtgtttattatgtgttttgttgttggaattattattattttgggtttatatagttgtgatgtatttttttgtttttttttgagggtagatgtttttagaaataatattttgtttttttttgatatttttatttttaggtggtataatgttttatgggaattgtttagaagttagggttttattatgatttttgttttattgatgggaagttttaaataataagttgttatgaggtgtgttttggtttttgatagggttttgttttttgttagattgggaaaattatataattttttagatttttagtttgttaatttgtaaatgggatgtgaatgttaatatatttgttataaattttataatttggaaattataggtgtaatataaagtagatagtaggttattagagttgaagttaattgttggaaaaaagatgaatgtttgggatagagagttgggtttgatgttttttgtggtgaaaggggtttttttttttttttttttataagttaagtgttttttatattttaggtattgtgttggttgtttatgaattagaatttggaaagtaaagaagtaggagaagaatgaggttgggttgaattggtttttggtgtgggtttatttattatagtgtagtttttaggatagtttttatttatggttttttattgtgtttagaggaattgtgatggggagagtgtttttgttgtatgggtgtttttagatgtataatgtttagtagattgaagtttgggggtgtttatgtttttgattttttgagtttggtatagtgttttttttttttgttatttttttttggtatgtggagagagagtaggttttttttttttagattgtgtttttatttttttattatattttagttttaatgtttttttttaaatagagatagtaaaagtgaaaataaattagtagagaaaaagtaagttttttgtaaagatagagtaatttaagtaagtttgtattttatataaattatgtagttaaaaaagtaaaattaaagtataaatattattggtttttagtagatgagagttatagtatggttttgaatttattattttatatatgggtgaatttatagttttatgtgtgggtgagaattattaattttgtatttttttaagtatgaaatgttttttttttatttgaatggatgttagaatgtagatttttgtgtattattttttgtttttgttattttgatggtgtttttgaaataggttagataaatagtgttgtggtaaggtgtggttttttgtgggtaaagttagattttaaagttgggttgtgttggttttttgggtaagattaaggttagggatttttgtttggtatggggatttttatatgtagttgggagtttttattgttagtagaagggtttttgggtttagtttttgggttttgttttttatgtgt

SEQ ID NO: 266 - DNA, 2523 bp, Artificial Sequence
  chemically treated genomic DNA (Homo sapiens)
tttgtgttaaaggttttgtgtggttgtttttttaatttgttgggttttttttatgttattatattgttttttatttttatttttatttttttagttattttaaatttatgtataattttttttttttttttttgatagatttttattttgtggtttaggttggagtgtagtggtgtgattttggtttattgtaatttttattttttaggtttaagttatttttttgttttagttttttaagtagttgggattataggtgtttattattatgttttgttaattttttgtatttttagtagatatggggttttattttgttggttaggttggttttaaatttttgattttaagtgatttgttttttttagttttttaaagtgttaggattataggtgtgtgttattatgtttggtttataattttttaattgttttattattatttttggtttttaagatattattgattgggtgtagtggtttatatttgtaattttagaattttgggagattgaggtaggtggattgtttgagtttaggagttggagatagtttaggtaagttggtgagattttttttataaaaaaatagaaaatgtttattggatttggtggtattgtttatagttttagttatttgggaggttgaggtaggaggataatttgagtttaggggtttaaggttgtagtgagttatggttgtgttattgtattttagtttgggtgatagagtaagattttatttttttaaaaaaaaaatggaatattaaaaattagaagatggtgttgtgtttgttagttttttggggtgtgagtttattattgtgggttattttttttatggagtttaagttttagggggatatatttttatggagggtgtatgtttgtttttgttggagtttgggtggtttttaggttttggaattagattttatattttttattttgtttattggttgttagtggtgttttatttgtgttttggtgatagaggtagtgttttgggggtataggtattggtgttagttttgagtttgaattttagtttggttttagttagttgtatggttgagggtgggtgggggatgtttttgttttgattttttatatttttatttatagtgtagttttattttttttataggagttggagggttatatgggaaaataggtatggtagatgtaaaaggtttagtggaaatgttggttttttttgttgttattattgtatttatttggtaattttgtattataatttgagatttagaagattttatgttttaggtggggttgaataggatagattttgaagagttggtttttagattggattgttaataattaggttggattttgtgtttttagttggttagtgttttggtaaggtaggagtgggtgaaatttttagtttttttagggagtagttagatgatgatatatttatatttgtttatagggagggagtgtgataaggtttgtggttttttgtgtgagaattggttagtgttttttggggtttgggatggggttttagtatttatttttattattggggtttgggagggagggttggagagtttttatttggtgttgttggtggttattttttagatagtgtgggtgggtttgtaggttttgggtaaatgtggtgttgttatagttttgttttatagggatagtggttagtagttgtttttggttttgttgtttttaatgaagttatagatggtagtttttaaatgtttttagaaatggtagagaggtttttagagttgatgtgtaaataaattgttttttaggtttggattatataattttgttgggattaagtataggtttgggttttttggttgttttttagggtttggttttgttgagaggaggaagtttggtttttgggagggggttttaggtgttttttttatggagtttagtaatttggtaggtgggggtgggtattgttttttttttgggattttatttttttggtaattagttgttttttttttttttggggttttaggtggtttttatggaggggtgggtgggattgaggtttgagttttggggaggagttggttggtgagttatgtattttagtggttattgtggttagttggggaggttgaattttaggttttagtatttagaagttggtggagtgggttgaattgagtttttttaaaaatgtatgttgaagttttgattttgggtatttgtgagtattggaaatggggtttttgtgaatgattgagttaagatgaggttggatggggagggttttaaaagtaatgattggtattttgtaaggaggttgttgatagtagggagaagttgggtgtgtgatgttagaggtagagattggagagaggtagtttaggaatattatgggtggttggtagtgtggagtggtagggtttttttttggaggttttggagggagtgtggttttgtggatattttgattttaggtttgtggttttagggttggaggggttgtgtttttgtggttttagttttta

SEQ ID NO: 267 - DNA, 2523 bp, Artificial Sequence
  chemically treated genomic DNA (Homo sapiens)
tgggagttaaagttatggaaatgtgatttttttagttttggggttgtaagtttgagattgaggtgtttgtagggttatattttttttgaagtttttaggggagggttttattgttttgtattgttagttatttgtggtgtttttgggttgtttttttttagtttttgtttttgatgttatgtgtttgatttttttttgttgttagtagtttttttataaggtgttggttgttgtttttgggattttttttgtttgattttattttaatttgattatttataaagattttatttttagtgtttgtaggtatttggggttagggttttgatatatgtttttggaggggtttaatttaatttattttattagtttttgagtgttggggtttgggatttaatttttttggttggttgtagtgattattgggatatatggtttattagttagtttttttttggggtttaggttttagttttatttatttttttatgaggattatttggggttttagagaagggagaggtagttgattgttggggagatggagttttgggggaggggtggtgtttatttttatttgttaggttgttgggttttatggagggggtatttgagatttttttttaagagttaggttttttttttttagtagagttaggttttgaggggtagttggagggtttaggtttgtgtttggttttagtagaattgtgtggtttgagtttgagaagtaatttatttgtatgttagttttgggagtttttttgttatttttggagatatttaagagttgttatttataattttattagggatggtggggttaggggtagttgttgattgttgtttttgtagggtggggttgtggtaatattatatttgtttagggtttgtgaatttgtttgtgttgtttgaggagtggttattgatggtattagatggaggttttttagtttttttttttgagttttggtagtgagagtgggtgttgaaattttattttgggttttaaaggatattggttgatttttgtgtagaaagttataggttttgttgtattttttttttgtggatgggtgtggatgtgttattatttgattgttttttgggagggttgggagttttatttgtttttgttttgttaaggtattgattggttggaggtgtggaatttggtttggttgttggtggtttgatttggggattggttttttgaggtttgttttgtttagttttgtttggggtatagggttttttaggttttgggttgtggtgtggggttgttagataaatgtagtaatggtagtaaggagaattggtatttttattgggttttttatgtttattatgtttgtttttttatgtggttttttgatttttgtgagggaggtgaggttgtattataggtgaggatgtgggggattaaggtaggggtattttttatttatttttagttatgtagttgattggggttgggttggggtttagatttaaagttgatgttggtgtttgtatttttggggtgttgtttttgttattaggatatggatggggtattattggtagttagtgggtggggtgggggatatggagtttggttttaggatttagaggttatttaggttttagtaaaggtaaatatgtattttttgtggggatatgtttttttggggtttgggttttatagaagaaatggtttgtaatggtgagtttatattttgagggattggtagatatggtattattttttaatttttaatgttttattttttttttaaagagatgaagttttgttttgttatttaggttggaatatagtggtataattatagtttattgtagttttggatttttaggtttaagttatttttttgttttagttttttaagtagttgggattataggtagtgttattaagtttaataaatgttttttgtttttttgtagaaagagttttattagtttgtttaggttgtttttagtttttgggtttaagtagtttatttgttttggttttttagagttttaagattatgggtgtgagttattgtatttagttaatagtattttaagaattagaaataataatagaataattaagagattataggttaggtgtggtggtgtatgtttgtaattttagtattttgggaggttgaggagggtagattatttgaggttaggagtttgagattagtttggttaataaggtgaaattttatgtttattaaaaatataaaaaattagtgggatatggtggtgggtgtttgtaattttagttatttgggaagttgaagtaggagaatggtttgaatttgggaggtggaggttgtagtgagttaagattatgttattgtattttagtttgggttatagagtgagaatttgttaaaaaaaaaaaaaaaagattatatatgagtttaaaatgattaaagagataaaagtagaaatgaaaaataatataatagtatgaaaaggatttagtagattagaaaaataattatataggatttttaatatgag

SEQ ID NO: 268 - DNA, 2280 bp, Artificial Sequence
  chemically treated genomic DNA (Homo sapiens)
tattgttttgtttgttttgagaatagtatttaatgtgattgtgtttttgtagtagatgttaggttgttgtttatgttttgagtgttggatgaggttaatataggttttttgttatagaatatgtttgggtaggaagattggaatatttggggttgggtatttattgtttttttatggtatatatgagttgttagggaaatgtttgtttttgtgtgtgttgtatgtgtagttttttgggtagagttgtggagagttggatgtaggttaggtgtgaggaggagaggtgtgtttggggtggttattggttttttttttgtgtgatgtaggttggtgtgggttttttttttagttttttgttggtgttgttatgtgagaagggtttgggtgttggttttgttattttggaattgtgggtttatttgaagtttgaggttaaatttttagtggttagtgggatgttagttgtttttgattttttggttaagttggttttgttgtgatttgtgagaatgtttaagtgttaatgtgttttggggggtagggttggggttgggattttagtgtgtgtttagttttttttttgtttttgtgggttttattatttttttattttaatgtattgttagggatgtggttaggttgggtttatttttagggtggtttaaggggattgttttttggtttgttaggaaggtaggttagtaagaagggttttgttgagttttatttgttaaggatagggttttgtaggtgggttagggttggtttaaagtggttgagatgttgatttgttatgtgtggggtgttgttggtgttttttttttagtaaagggtggagggagtggatgtgggggaagggtaggtgggtatttttggagtaatattgttattaagaggaattggtttggtaattttgtgtattttttgttgtgtttgtttggggaggagtggtttgggattgttttgggggattaggtaggattagggtaggtgtttggatggatttgaggtttttggaggtttgagagaagtaggttttgttgtggggttgggtggtggaagttttagagagaggtgttaggattagttggatagttaggatgttgggttgtttttggataggaagttatggtttgggagtttggtggtggttatgatttgggtgggattagtggaggtttttgttagggagtttgggtttggggttttgggtagtttgtttggtgtttttttttgtgggagtaattggggtgatggtttagttgggtttttggtttgggaggttttgttggttatattgtatgtttgtggtgtgaggagggttgattgttagtgttgagttttgtggttattggtgtgggtgtttgttgttgttggttggtgttggggtgtttttttttgtgttttagggaggaaggtgggttgtggggtattttgtggggtttgtatttagatggtttttgatgaggtggatgtaaggttaggtttggtttggtttggtttggtttggttatttttagatgttgtgtatttgttttgttgagatttgttattttgttttgttgtgtttatgtttttgaggttgttttggaggtgggttgttttttgtggtgtttatttttgtttgggggttttttggggattttgtttgtttttgggggtgtgtaggtttttgttttgtgattagaggtgtattgattgatgagtttggtggtaaagtttgagaaatggagattttttgggtattggttaagggggtttggggtttttttaggtttgttggagtttgggaagttgggggtatttagaaggaaggatttgttggattttgtttggggatagtttgttttgtgttagaagggtttgttgtttaggtagtatttttgtgttttttttttagtgggttttttaggtagaattggggtaggttttattggatgtgtagggaggaggtttggaggatgtattttttgtaggatttggtttggtatagtagtagatggagttattttttggggttttttggtttttttgagggtgtttaggagttttttaagtgtgtaggggtttgtgtttaaagggtggaggttggtattgttttgtttaatttaggagtggagaaggaagttagaggattttttggaggtggtaggtttaatgttttgtttttttatttatttatttatttatttatttatttatttattttgtaattaattgaaagaaggtagaaggagttgatgggttttttaggttggaaattttataagtattaggatt

SEQ ID NO: 269 - DNA, 2280 bp, Artificial Sequence
  chemically treated genomic DNA (Homo sapiens)
ggttttaatgtttgtaaggtttttggtttaagaggtttattgattttttttgtttttttttagttgattataaaataaataaataaataaataaataaataaataaataaaaaagtaggatattaaatttgttatttttagagggttttttagtttttttttttatttttgaattgagtgaagtggtgttgatttttattttttgggtatgagtttttgtgtatttgggagatttttgaatatttttggagaagttagaaagttttgggagatggttttgtttgttgttgtattagattgggttttgtaaaggatgtattttttgagttttttttttgtatgtttagtggggtttgttttgattttatttgagggatttattggaggagaggtatggggatgttgtttgagtagtggatttttttggtgtggagtaggttgtttttaggtagagtttgatgggtttttttttttgggtgtttttggttttttggattttagtaggtttgggaaggttttgggtttttttagttgatgtttagagagtttttattttttaagttttgttattgaatttattggttggtgtgtttttgattgtagggtaagggtttgtgtatttttaaagataagtggggtttttggaaggtttttaggtagaaatgagtattatggggaatggtttgtttttaagataattttggggatatggatataataagatagggtggtaagttttaataaggtgggtgtgtggtgtttgaaggtggttgggttgggttgggttgggttgggtttggttttgtgtttattttgttaagaattgtttgggtatgggttttgtgggatgttttgtggtttatttttttttttaggatgtaaggaggaatgttttggtgttggttagtagtggtgggtatttgtgttaatggttatggaatttagtattggtagttggttttttttatattgtaggtgtgtagtgtggttgatggagttttttgggttgaggatttagttaggttgttattttggttgtttttatgggaaggggtattaggtaaattgtttaaggttttgagtttaggttttttggtggaggtttttgttggttttgtttagattatggttgttattaggtttttgagttgtggttttttgtttgggaatggtttggtgttttggttgtttagttagttttggtgtttttttttggggtttttattgtttgattttgtggtggagtttgttttttttggatttttagagattttggatttgtttgagtatttgttttagttttgtttggttttttaggatagttttaagttatttttttttaggtgagtatagtgaagggtgtgtgggattgttaagttagttttttttgatggtagtattgttttagaaatgtttatttgttttttttttatgtttattttttttgttttttgttgaggaaaaaatgttaatagtgttttgtatatggtggattagtattttggttgttttgggttagttttggtttatttgtgggattttgtttttggtagatgggatttggtgggattttttttattagtttgtttttttgataaattagaaagtggtttttttggattgttttggggatggatttgatttaattgtatttttaatgatgtgttaggatgggaggatggtggaatttgtagggatgagaaggagattgggtatatattaggattttagttttggttttgttttttgggatatattggtatttgggtatttttatgggttatggtaaggttagtttgattaagaggttaaaggtgattggtgttttattgattgttgggggtttggttttaaattttaggtgaatttataattttggaatagtgggattggtatttgggttttttttatgtggtagtattggtaaggggttgggggaagagtttatgttagtttatgttatgtaggaagggagttagtggttattttaaatatattttttttttttatatttggtttatgtttaattttttatggttttgtttagaaggttgtatgtataatatatatagaggtgggtatttttttgatgatttgtgtgtgttgtgggggagtggtagatgtttagttttaagtgttttgatttttttgtttaaatatattttgtgatggaaagtttatgttgattttgtttggtatttaaggtgtgggtagtggtttaatgtttgttgtgggaatatagttgtgttgaatgttatttttaagatagataaaatagtg

SEQ ID NO: 270 - DNA, 2413 bp, Artificial Sequence
  chemically treated genomic DNA (Homo sapiens)
ttgtttgttttatttagggatagatttgtagggtagggatttttttgtttatagaggtatatgtggttttggtgtgttttaaaatttagttttttatggttgttttaatttgagttttgtttttaaggttttaaagttagtttgtttttttagaggtggggggaagtagttgtgttttttattttaggatatatatgtatttattttttataatatataggtagatatatatttagtttttataaaattatgggtagatatatgtttagtttttatagtgtaatggttttaaatgtatttgattttaatgttatatatatatatttggtttttataatattagggttatatatattttttgtttttatgatgttatagttttgggtgtttttttattttggttattgtttttggtgtggtgtttttattggtgagataggatgttggttttagagtttattggtttttgtttatattgtgtgggtattaatgttgttaggtatagttggtggtgagttttgggtgttttttaggtaggttgtgttgatttttgttttatttgtattgaattgtttttgaggtttatttattgttgattttatgtagggttatatttggtttattggttagtgttaaagtttatttggtttattgggtttggttttattttgtttaatttatttttggttggatttttttgttatgttttttagtattgtattatttttagtttgtttagtttttatttttgttggtagtataagtgttgtttagaagagttgggggtgtttgtggatttttttgttggtttttgtgatgttgttttaatttatatttttttttttggtaagggaaagagaagagaataaagtgtagtaggtttagatttagaagtttaggtttatgagttaatagaagatgttaagatgttgatgtagtatgatttaggagatagtagggaatatagttttagtggaatgagattaggttttgttttttattttgggtttgttgaggggatgtgtgtatttatttggttattattatttttatgagtatttttagggttgggtattttttttatgtagttaggtttagggaattggagggtgtggggttggttaggtttttttgggtattaggtgtgtgatttttgttttttttagtttttttttttatttttagttgggtttattttaagttttaatagataaattgttttaaaggaataaggattagtagggttatgtgtgtgtatggggtggttagtagaggtttattgatgttttttgggttgaatgtggtgatgattagtaggaggggttaggttttttagtagagggtagagatggtgaggtttggaggttggtatttggaaggtaggggtgttttgatttaggtttagtgtattaagtttagtgttaaggattggttgggttaggtggtaaagttggggtagggatggtgttggtttttagttttttttgggattgttttttagtgatatttgtttaagtatgtgtattagtttggttttgggttttttgtttaggtttgattttggttttgtttttatttttttaagtttttgttttttatttataaaatgggagtggtggtggatatataataaatgtttattaagtgataatgatttttgtattttatatgatataatagatattattttaggagttattgagatggaattattgtaatgatataattaaattaaagtatgggttttttgggtgaggaaatggattttggttatgagatagatgtgaattgaggtattgtttggagttatatgtagaggttgttgagtgggaaagattatattagaaagtagagtgggtagtatttgttgaaggagagaggtaggagaattttaattatagtattagagagtatgtgaggtttaagtgtagtgtgggattttgaagtgtgtttgattaaaattttaaatgttattgaaagggtgttagttttgtataaagggatgtttttgaaagggtgttagttttgtataaagggatgtttttgaaagggtgttatttttgtataaagggatatttttgaaagggtgttggttttggataaatgggaatttttgaaagggtgttggttttggataaatggatattattgaaagggtgttagttttggataaatgggaatttttgaaagggtgttgtttttggataaatgggaatttttgaaagggtgttggttttggataaagggaaatttttgaaagggtgttagttttggataaagggaaatttttttatgtgtatggattgtagggtgtggttttattgatatggtggtattttttagattgatttatggattttatattgttttttttgaaattttagttatttgttttgtagaaattgataagttt

SEQ ID NO: 271 - DNA, 2413 bp, Artificial Sequence
  chemically treated genomic DNA (Homo sapiens)
gagtttgttagtttttgtaaaatagatgattgggattttgagggagatagtgtggaatttatgggttagtttggggagtgttattatgttagtgaggttatgttttgtgatttgtgtatgtgggaggatttttttttatttagagttgatatttttttaggggtttttttttatttagagttgatatttttttaagggtttttgtttatttagaggtgatatttttttaggggtttttgtttatttggagttgatatttttttagtggtgtttgtttatttggagttaatatttttttaggggtttttgtttatttggagttgatatttttttaggggtgtttttttatgtagaggtgatatttttttaggggtgtttttttatgtagagttgatatttttttaggggtgtttttttatgtagagttgatatttttttagtagtgtttggagttttggttggatgtattttggaattttgtattgtatttgagttttgtgtgttttttgatgttgtggttgaggtttttttgttttttttttttggtaggtgttgtttgttttgttttttggtgtggttttttttatttagtagtttttgtatgtggttttaggtagtgttttgatttatatttgttttatagttaggatttgtttttttatttgaggggtttgtgttttgatttaattgtattgttataataattttattttggtggtttttggggtggtgtttgttatgttatgtagagtataaaaattattgttatttaatgaatgtttattatgtatttattattgtttttgttttgtagatgggaaatagagatttagaaaggtaaggatagagttggagttgggtttggatagggagtttagagttaggttgatgtatatgtttggataggtgttattggagggtagttttgggaggagttgggagttagtattgtttttgttttagttttgttatttggtttggttgatttttggtgttgagtttggtgtgttgggtttgagttggggtgtttttgttttttaggtattagtttttgaattttgttatttttattttttattggaaggtttggttttttttgttggttgttgttgtatttaatttagagaatattggtgagtttttgttggttgttttatgtgtatatgtggttttgttggtttttatttttttggggtagtttgtttgttgggatttgggatgagtttagttggggatgagaggaggagttgggagaagtgggggttatatgtttggtgtttaggggagtttggttagttttatattttttggttttttaggtttggttgtgtgggaggagtatttgattttgaagatgtttatggagatggtgatgattaagtgagtgtgtatgtttttttggtgggtttgggatggggagtagggtttggttttgttttgttggggttgtgttttttgttgttttttgggttgtgttgtattagtattttagtattttttgttgatttatggatttgagtttttggatttaagtttgttgtattttgttttttttttttttttttgttgggagagggggtgtggattgaggtggtattatggaggttagtagggaggtttgtaggtatttttagtttttttgggtagtgtttatgttgttgataggagtggggattgggtaggttgggggtggtgtgatgttggaggatgtggtaagagaatttggttagagatgggttagataggatggagttaggtttagtgggttaggtgggttttaatattggttagtgggttaggtgtgattttgtgtgggattagtagtgggtgagttttaaggatagtttagtgtaggtgggatgagagttggtatagtttgtttaggagatgtttagggtttattattagttgtgtttggtagtattggtgtttatatagtgtgggtgagggttgatgagttttggggttagtattttattttattagtgagggtattatattaagggtagtggttaaggtgaaggggtgtttgaggttgtggtattatagggatggggagtgtgtgtggttttggtattgtggggattaggtgtgtgtgtgtggtgttgggattgggtatgtttggggttgttgtattgtgaggattgggtatgtgtttgtttatggttttgtggggattgggtgtgtgtttgtttgtgtgttgtggggagtgggtgtgtgtgtgttttgaggtgggaggtatagttgtttttttttatttttgaaggagtagattgattttggggttttggggatagagtttagattagagtggttatggggagttgggttttggaatatgttgaagttatgtgtgtttttgtaggtaagagagtttttgttttgtaggtttgtttttggatggggtgggtag

SEQ ID NO: 272 - DNA, 2171 bp, Artificial Sequence
  chemically treated genomic DNA (Homo sapiens)
taagagaaaaataaaaaattttattaaatgttatggataaggttagagtttgaatatattgtggttatttttgttttagtgtaaattgtttttagaaagtttatttttattttttttgttgtaatagaggaatattttttgttttatgtttattttattttgtaattttttaaggtttttttttttttttttagaattttaaagtgtatttgaatttataggtaaaatttttttagaattttgtgagaatataaatgatttgattagtttggtattgtttttggggatttgggaaaatttgtgtatatttttggagatttttgttatgttattatttataaatttattgtgttttaagttagaagtgtgtgaggggagatggggagatattgggatgtgtgtgtttggggtttttttatagggggtttttgtgagttaggtagtgagggttgtttttgtgttgtagtttagttaggttgtgttggtagaggggattttttaatttgttttggtgtgtggggattttgtttatgttgttttggtttttttggagttggggtgtttttttatttttaggttttttggtggtttttgtatttgggtaaaagttgggaggattgggatttgtagtgtgatggtttgttgggtttttgtgtggtggtatagtttgggtttgtttaagtggggttgtagggttaaggggtgtttgtgttatttatgttttaggggagtttgtggtggggttggggttggggtttttaggttgttggggtggtgtgggaattttaagttggggtagttttatttttttagtttgtgttttttggatgtttttgtttttgtgtggtaggggtagatgtaaggtattttggtgtttttttaggtgttttaggagttggtgttttggtttgtatttttttgtggtttgttgttggatgagtttttggtgagtttggagtttttgtagtaggtgtaattttttttagaaatggaggttttgggggagttggaggttttggaagaggtgttttgttggaagtattttttagtgaggaagaatattgggttttgttggaggagttttaggatgtggggttgggatggggttgggtggtttggggtagggtggtggttttttttttgtggggaatatttggttggttatggaggggtgtgtttttgttttgttttttttattgggttgattggtttgggatttttgttttttaggtttaggttggtgagagattttatattgtggagaattgttatttttttttgggtattttggggattttagagttggtttaggtattagtaggtgggttgtttattgtgtatgtgtgggtttgtgggtagttgtttgggttgtgggagtagtttgggtagagtttttttgtttttttattagtttattttgttgtttgattgttttatttttattttttattttttatttttggaaaatgtgttgttttttgggttgggtggagatttttgttttgtgaaatattgggttttgtgtagtgtttgggtttgatattgttttggtggtttgttttttttttgttgtttttgggttattgttgtttgttgtttgggtttttgtagttgtttagttgttagtatggagtgtttggtggtggaatgtagattttaggtttggtgtatattgggatgttgagtgttttaggtgggagggaaggtgggtagagatggagagaggaatgggagatttagaggggtggaaggatgggtggagggatgttaggagggaggtagggaggtagggaggtagggaggaatggagggagagatagagtgatgtagggattgggggtgggtgggagggagttggggatggatggggggaggaaggtagggaggaaaagtggtttttggtttttgggagtagtgggatttttgttttttgggaaaatggttagtgtttggtgtgggttgagggttgggtttatagttgttgtgttggttggtggggtattatttatttgttttggttttggggtttagggagtgggtggttttttttgggataaaagattgggatttgggttgttgttgggtttttatttgtgtggtttatagattgtatatttttaggttgagttttgtaatgtggtgtgaggttgatagatttggttatggaggag

SEQ ID NO: 273 - DNA, 2171 bp, Artificial Sequence
  chemically treated genomic DNA (Homo sapiens)
tttttttgtggttgggtttgttggttttgtgttgtgttgtagggtttagtttggggatgtgtggtttgtgaattgtgtgggtgaaaatttgatggtaatttgagttttggttttttgttttggaggaaattgtttattttttgggttttggaattggggtgaatgggtggtgttttgttggttggtgtggtggttgtgggtttagtttttagtttgtgttggatgttgattgtttttttggagggtgggggttttgttatttttggaggttgaggattgttttttttttttgtttttttttttttgtttgtttttggtttttttttgtttgtttttagtttttgtgttgttttgtttttttttttgtttttttttgtttttttgtttttttgttttttttttaatgtttttttgtttatttttttgtttttttaggttttttgtttttttttttatttttgtttgtttttttttttgtttggaatgtttagtgttttggtgtgtgttgggtttggggtttgtgttttgttgttaggtgttttgtgttggtagttgggtggttgtaggggtttgggtggtgggtgatggtggtttgggggtgatagggaggaggtgagttgttggagtggtgttaggtttggatgttgtgtggggtttggtgttttgtgggatgggggtttttatttagtttaggggatgatgtgttttttgggggtggggggtggggggtggggatggggtggttaggtggtggggtgggttggtggagaggtaggagagttttgtttgggttgtttttatagtttaggtggttgtttgtaaatttgtgtgtgtgtagtaggtggtttatttgttggtatttgggttggttttgggatttttgggatgtttaggaaagaatggtagttttttgtggtgtggagttttttattggtttggatttagaaggtaggaattttaggttggttagtttggtggagggggtggggtggagatatgtttttttgtagttagttaggtgttttttgtgaaagagaggttattgttttgttttgaattatttgattttgttttaattttgtgttttaaagtttttttagtagagtttggtatttttttttgttgaggggtgtttttagtgaggtgttttttttgaggtttttagtttttttggggtttttgtttttaggagaggttgtgtttgttgtagaaattttgggtttgttaggagtttatttagtagtaggttgtaggggagtgtagattagggtgttggtttttggagtgtttgggagggtgttgggatgttttgtatttgtttttgttgtgtggaggtggaggtgtttggggggtgtgggttggggaggtggagttgttttggtttggggtttttatgttgttttggtgatttggggattttggttttagttttattatggatttttttgggatgtgggtggtgtaagtattttttggttttgtggttttgtttgagtgggtttaggttgtgttattgtgtaggggtttggtaggttgttgtgttgtgggttttggtttttttggtttttgtttgggtgtggaggttattgaggagtttgagggtgggagagtgttttggttttggaggagttggggtggtgtaggtgaaatttttgtgtgttggggtaggttgggagattttttttgttggtgtggtttggttgggttgtagtgtgggggtggtttttgttgtttggtttatgaaagttttttgtgggagagttttaggtgtgtgtattttaatgtttttttatttttttttatatatttttgatttgaggtataatagatttataaataatggtatgataagggtttttagaagtgtgtatagatttttttagatttttaaaagtaatgttaaattagttagattatttatgtttttataagattttgggaggattttgtttgtgagtttgaatgtattttaagattttgggagggagagaaaaagttttaggggattgtagagtagaataagtataagataggaaatgtttttttgttatagtaaggaaaatagaagtaggttttttgaaaatagtttgtattggagtagagatgattatagtatatttaaattttggttttgtttgtgatgtttaatagggttttttgttttttttttg

SEQ ID NO: 274 - DNA, 2490 bp, Artificial Sequence
  chemically treated genomic DNA (Homo sapiens)
gattagtatggttattatatttatagttattagttttagagttatttttttttttagtttagggattgtaattgtttttttagtattgagaagtatagttattatatttatagttattagtgttatagttattttttttttttttttgggtattgtttggatttgtttattatagattattatatttatggttattatgtttatagttatatttttttttattttagagattgtttatatttttatagtgtttattattatgattattataattagggttattggttttgtggttatttttttttttattttaggaatagtttatattattaaagtgttgattattataattatgggttttatagttatttttttttttagtttagggatggtatttatgtttttagtgtggattagtataattattatatttataattagaggttttatggtgatttttttttttattttggggattatttatattgttatagtgttgattattattattataattgtggttattggttttatggtaatatttttttttagtatatagattagtggtatttttttattattgattattatggttattatgattatagttattggttttattattaatttttttttaattttagggataatttttatttttttagtgttgattattattgttattatatttgtagttattagtagtatagtgatttttttttttgttttagggattatttatatatttttagtgttgaatattatggttattatatatgggtggtttttgttttttagtagtttttatatggtgtgtatagtttggattttggttattttgggtattttgggtattatttatattatagagttttttatggtgattttttatattttagtagtaattattagtattatttagtatttgattttagttttgtttagtttttattttagtagtaggattattgagttatttttttttttagggatgattattttgggttatattaggggtatttttaggattatagttatagttatatttagtaagatttgtattttgattttgttgtttagtagttttatattggtttttataattatggtggtgattatgggttgtgagttttagtgtgtttggttagagtggttggattatagttattttatgttggggttttttggtggggattttgatatttattttaatatttgtgtggttggaggggtagtttgtgagtagtttttgggttttgagtgttgtgtttaggtttagtttggtgtttttttgtgggagttgggttaggttgtggaatgtagtttggattttggtttggtttgtaggaattgtgagtaggtggggaagtttaagatgtgttttaattatgaaatttgtgtgttttgttgtaattatggttattgttttagtattttggttattagttttatggttatgttttttttaattttggggatgatttggatttttataaagttgattataatagttattatgattgagtttattggatttatggttattttgttttttattttagggattatttggatttttatagagttgagtattatagttattgtgatggtgtttattggatttatggttattgttttttttatttaggtaattgttggtattttatatgtgagtattatggttatgatatttatagttattagttttaaagttatttttttttttagtttagggattgtaattgtttttttagtattgagaagtatagttattatatttatagttattagttttatagttattttttttttttttttgggtattatttggatttgtttattatagattattatatttatggttattatgtttatagttatatttttttttattttagagattgtttatatttttatagtgtttattattatggttattataattagggttattggttttgtggttatttttttttttattttaggaatagtttatattattaaagtgttgattattataattatgggttttatagttatttttttttttagtttagggatggtatgtatgtttttagtgtggattagtataattattatatttataattagtggttttatggtgatttttttttttgttttggggattatttatatttttatagtgttgattattattattataattgtggttattggttttatggtaatatttttttttagtatatagattagtggtatttttttattattgattattatggttattatgattatggttattggttttattattaatttttttttaattttagggataatatttatttttttagtgttgattattattgttattatatttgtagttattagtagtatagtgatttttttttttgttttagggattatttatatatttttagtgttgaatattatggttattatatatgggtgatttttgttttttagtagtttttatatggtgtgtat

SEQ ID NO: 275 - DNA, 2490 bp, Artificial Sequence
  chemically treated genomic DNA (Homo sapiens)
gtgtgtattgtgtggggattgttgggggatagggattgtttgtgtgtggtggttgtggtgtttggtattgggggtgtgtgggtggtttttagggtagaggagggagttattgtgttgttggtggttgtaggtgtggtggtggtggtggttagtattggggggataggtgttgtttttggagttgaggaggggttggtggtggagttggtggttgtgattgtagtggttgtggtgattagtgatgggggagtattattggtttgtgtgttagaggagggtgttgttatagaattagtggttatagttgtggtggtggtggttagtattgtgggggtgtgggtggtttttgggatggaggagggggttattgtggagttattggttgtgggtgtggtggttgtgttgatttatattggaggtgtgtgtgttgtttttgggttggaggagggggtgattgtgaagtttgtggttgtggtagttggtattttggtagtgtgagttgtttttggggtggaagagggggtggttatagagttggtggttttggttgtggtggttgtggtggtaagtattgtggaggtgtgggtagtttttggagtggaggagggtgtggttgtggatatggtggttgtgggtgtggtggtttgtgataggtgggtttaggtggtgtttagggaggaggaggggatggttgtaaagttggtagttgtgggtgtggtggttgtgttttttagtgttggaagggtggttgtagtttttggattggagaagggagtggttttggagttggtgattgtgggtgttgtggttgtggtgtttatatgtggggtgttagtagttgtttgggtggaggaggtggtggttgtggatttggtgggtattgttatggtggttgtagtgtttggttttgtgaggatttaggtggtttttggggtggaggatggggtggttgtggatttagtggatttagttgtagtggttgttgtggttagttttgtgaggatttaggttgtttttggagttgaggagggtgtggttgtagagttggtggttggggtgttggggtagtggttgtagttgtagtagaatatatggattttatagttgaagtatattttgaatttttttatttgtttatggtttttgtagattaggttaaagtttaggttgtattttatgatttggtttaatttttgtagggggatattaggttgggtttgggtatggtatttgaggtttaggggttgtttatagattgtttttttggttgtatggatgttggagtaggtgttaaagtttttgttagagggttttggtatggggtagttgtagtttagttattttgattaggtatattggggtttatagtttgtggttattattgtggttatgggggttgatgtggggttgttgggtagtagggttgaggtgtgggttttgttgggtgtggttgtggttgtggttttggaggtgtttttggtgtggtttggggtggttgtttttggagaagggggtgatttggtggttttgttgttagggtgagggttggatagggttggagttgagtgttgggtggtattggtggttgttgttggggtgtgggaagttattgtggaaggttttgtgatgtgggtggtgtttaagatgtttgaggtggttgaagtttaggttgtgtgtattgtgtggggattgttggggggtagggattgtttgtgtgtggtggttgtggtgtttggtattgggggtgtgtgggtggtttttagggtagaggagggagttattgtgttgttggtggttgtaggtgtggtggtggtggtggttagtattggggggatgggagttgtttttggagttgaggaggggttggtggtggagttggtggttgtgattgtagtggttgtggtggttagtgatgggggagtattattggtttgtgtgttagaggagggtgttgttatagaattagtggttatagttgtggtggtggtggttagtattgtggtggtgtgggtggtttttgggatggaggagggggttattgtggagtttttggttgtgggtgtggtggttgtgttgatttatattggaggtgtgagtgttgtttttgggttggaggagggggtggttgtgaagtttgtggttgtggtagttggtattttggtagtgtgagttgtttttggggtggaggagggggtggttatagagttggtggttttggttgtggtggttgtggtggtaagtattgtggaggtgtggatagtttttggagtagaggagggtgtggttgtggatatggtggttgtgggtgtggtggtttgtgataggtgggtttaggtggtgtttagggaggaagaggggatggttgtaatgttggtagttgtgggtgtggtggttgtgttttttagtgttggaagggtggttgtagtttttggattggaggagggagtggttttggagttgatgattgtgggtgtggtggttgtgttggtt

SEQ ID NO: 276 - DNA, 2418 bp, Artificial Sequence
  chemically treated genomic DNA (Homo sapiens)
agtagagttggggtgtggagttgggtttttttgttattattgttatttttaatggtgttagtgttggtgggtgtgtaagggttgtgaaagttattgtgtgtggtatggtaggttttattggagggtttttttggttgaggggtttgttgtggtgttggaggggtaggggtttattgttttttatgaggtttttttttttttgatagtggtgagaaggtgtttgtttattagtgtttttatgttttggtttagtttggtttgttgggatttgtgttgttttataagtattaggtgttggtggagatgttttgtagtatggatattattgtgggtatgttttataattgttttgagatgtttatttttgttaaggtttagtggggtgtttaggatatgatgtgtaggtgagtggttgggggtgggttgtggttgttttggagttgggggtgggtttgggtttgttttttgagttgtttttatttttttataggtgttttgaggagtgtaatgttggttagattaaaattgtgtatttggttttttattgtttttgttaggagtgtagtgtttttatttttaaggatggtattaggaggttagattattagtttattattgagttattgttggagtagggtgagtgttgggtgtgggattttggtttttttatttgtgagttgtatagtttttagggtgggtgtgaggtgttgggtatttggtttaggattggttatgggtgggtggttgggtggtttggtggggatttaggtttggatttgttttatagaggttgatggagtagttttttagtttatggttttgtgttttttgtagtgatggtagatttttagttagaagttggtggagtatgttaaggagtattataaggtgagtggtttttggttttgttgtgtgaagatggtggtattagtattgttttagtatttaattttgtgtttggagtatttttgttatttatagttttttttgggatggaattgggttgggtttattttgagttgagggttggtgtgtttagggtgtagttgtaggtattgaggaggtttttaaggtgtttagtgagtgtggattatgggaggttttgtgttttttttttaagttgagtattgggtagaggttgagtgatttgtttgaggtggtttggttgggatgtaagtataggtttattttatatgtagtttgtttttgttttagatgtgtttagggttatttatttattttttttttttaggtttttttggtttttttgagttttgttatggtggtgttggaggattagttgatttgttggtatttgtgttttaatgtggatgaagtatttgatattgagttggttgtgttgttttagttatttgttatggagaagtttattattgtttaggaggtgttggtttgggtttgtaatttgattttatttagggtgagattgtgaggtttgggtagtttattttttttgggtgggtgggttagtttgattttaggtttaagaggtggaagttttggtgatgagtttgatgttttatttggttttttttttggttggtggatttagagagttggtggtatttgttttttgtttttagttgtagtttttaagtttggttttgttattagttttatgtggggagttggtttgggtaggtgatgttgtatattgggatattgtattgattggtatagattatttagtgtgttgggtgaatttgtgttttgagagatattggggatttttgggtagatagttaggggtatgttgtattttgtgatttttttagtttaatttgttttttttgtagatggagaaggttttgagttaattggttttgtgttttgttgtgtttagtagttttgggttttttaggttagtattgttggttattttattagttattttgtttgtagttttttttagtgttttgaagggggtgttttaggatttgttggagtgggtgagttgtttttagtgatggtgggtgggtgtttggtgatttgttgtttattaattaggttttggtatttgttgtagatttgagttaaggaggtatagaagtagttggtatagatgatgtggtgtttggagtaggagtagtggttgtagtgtttagaatggttgtttgagttggtttgtgtgttgtggagtgtttttgtgtttgaatgtaagtttgtgtttagtatggaggtggtttgtgttaggatggtgggtagttgttgtattattatgagttttggtatgtgtagggtggggtgaaggggtgtgtagggtggaattgtttggtgttgtagttgtttttttagttttttgagtagaggtgtttgttattgatttgttttgtttagatgtgtagtgggtgttggttttttgtattggtgtgttttgggtgttttgttttttttgga

SEQ ID NO: 277 - DNA, 2418 bp, Artificial Sequence
  chemically treated genomic DNA (Homo sapiens)
tttaaggagggtagagtgtttaggatatattagtgtaagaggttagtgtttattgtatatttgaatagaatagattagtgatagatatttttgtttagaaagttggggaggtagttgtagtattaggtaattttattttgtatgtttttttattttgttttgtatgtattagggtttatgatagtataatagttgtttattattttggtataggttatttttatgttgagtgtaggtttgtgtttggatataaagatgttttgtagtatgtgggttagtttaggtagttgttttaagtgttgtagttgttgtttttgttttgggtattgtgttatttgtgttagttgtttttgtgtttttttggtttggatttgtagtaggtattgggatttggttagtgggtagtaggttattaggtgtttatttgttattattggggatgatttatttgttttagtagattttgggatattttttttagagtattgggagaggttgtaggtggggtggttggtggggtagttggtagtgttggtttgggagatttggggttgttgggtgtagtagagtgtagggttaattgatttaaggttttttttatttgtgggagggataggttggattggagaggttataagatgtaatgtgtttttggttgtttgtttaggagtttttggtattttttaaggtataagtttatttagtatattgggtggtttgtgttggttaatgtagtgttttagtgtgtagtattgtttgtttaggttaattttttatatggggttagtggtagagttaggtttagaggttgtagttggggatagagggtaaatgttattaattttttggatttgttagttaaggaggaagttagatgaggtgttaagtttattattaaggtttttattttttaagtttggggttaggttggtttatttatttgggagaaatgggttgtttaagttttgtagttttattttgggtgaaattaggttgtgggtttgggttagtattttttgagtagtggtgagtttttttgtggtgggtggttggggtagtgtggttggtttgatgttgggtattttatttatgttgaagtgtgggtgttagtgggttagttggttttttggtattattatggtggggtttagggaggttaggaaggtttggggagaaggagtagatgggtgattttgggtatatttgagataagggtagattgtatgtgaggtaggtttgtgtttatgttttagttgggttgttttgggtaagttatttagtttttgtttagtgtttagtttggagggagagtataaggttttttatggtttgtgtttgttgaatgttttggggatttttttagtgtttgtggttgtattttgagtatattagtttttagtttagggtgaatttagtttagttttattttgggagaagttgtgagtggtagggatgttttaagtatagggttaggtgttgaggtagtgttggtgttattatttttatatagtggggttgggggttgtttattttgtggtgttttttgatatgttttattagtttttggttgaagatttgttgttgttgtaggaggtgtgaggttgtgagttggggggttgttttgttagtttttgtgggatgagtttaggtttaagtttttattaggttatttagttatttatttgtgattagttttgggttagatgtttagtattttatatttattttggaaattgtgtggtttatagatggggaaattgaggttttgtatttagtatttattttgttttagtagtggtttgatggtgagttggtaatttgattttttggtgttatttttgaaggtggggatattgtgtttttggtggaagtggtaggaggttgggtatatggttttgatttggttaatattgtattttttaaaatgtttatgggaggatgggggtggtttaggaggtaggtttgggtttatttttaattttaggatagttatagtttatttttggttatttatttatgtattatgttttggatgttttgttggattttggtaaaggtgggtgttttggagtggttgtggagtatgtttatgatggtgtttatgttgtggaatatttttgttagtatttggtatttgtagggtagtatgagttttggtaggttgggttgggttagggtatggaagtgttggtaggtgggtgtttttttgttattgttagggagggaggagttttatgagaagtagtaggtttttatttttttaatgttatagtaggttttttggttagggagattttttgatggggtttgttatgttatatatgatggtttttgtggtttttgtatatttattagtattggtattgttaggggtagtagtggtgatgggaaagtttggttttatattttagttttgtt

SEQ ID NO: 278 - DNA, 2351 bp, Artificial Sequence
  chemically treated genomic DNA (Homo sapiens)
aggttggttttgtagtttttggggttgagtttttaaatgtgagttgggtgtgtgtgggatttgtggtggttttttgaagttttgtttttttggtttggggtttgtttggtttgttttaatagttgttttgtggttgtaggttttgtgttttgtgtattagggaaaagtagtttttgagtttgtgttggatgtttttgtgttttgttattggttgtttttggtttttgggtgaggtgttttttttttgttgtgttttgttgttgggtgtttttggttttggttttttgtgatttttgattttttttggtgtgaataagattgggtgttttgttgttgatgtgaaggggttgtttgtgtgtggtgttgtgggttttttgtgtgtggggtgtgtgtgtgtgtgtttgggtttggttttgtgtgtgtattgtgggtttgtttagagttgggattattgggttgtgtgtgggttgttaggttaggtttttgtttaggatgggttttaagttggaatgagaaaggggaaattggttgtgttgatgttggggtttttgttgtaagtgagaggtggatttggtgtatttgtgtggttttggaaatttttgagaggttttagttttttgttggttttatttttgttaggtggggaaggtggtttgggattgggtttgtttaggattagaagtggtgtttggtagttatttggttaggaggttggagagttgggtttagtgggagtgttgagtgttggttttttttttttgagagtttttagtgaggaaaaattttatgagaggtgattgttaggttttggttttttgtttatatttggttgagtgttgggaatttttttttttaggttttatagttgggattgtttgttttaggttttttaaggtggttgaggtaggtttaggattatattgtttgttttgagtaagaaggtaggatttgttgaagaattttattttattaggtgatattttaagtagatgtgaatttttttggggattatagtttattatttgagttagaggtggtagggttagtattttagttagtaggtttttttttttttataatgttgattaggttaggggattgtggggttgggtaggggtaaggttatggttattaggttggtatttaggttgggtatagaatagtaattaggttagtggaggtgattttatgatttagtattttgggggttattgttgagtgtgtatttggaggtgtaattttgtttgtgtttttttggagattttattttaagttttagtttaggtgggttagttttttggattgggttttgtgaagggttaaatggtggtggttttgggggtgatttgggtttttagttgagttttttaaggatagaggtggttattggggtatttaagttggggttgtggtttagttgatgggaaatttatagttttttttatttgagtttgggggttaggaatagagtgaggatagtttagggatagggttttttttattgaagttagggtggtagggttggtggggtaggggttgttgtagttttatatttataaatttaatgtttaataaaagtttattgtttttagggttgttgtgagttaggtgggtaggtggggggttagtattattaaggtgttttttggattattattgtttttatagtatagttgggggtttttgtgtaggaggaggatgtgttagttggtatttttattagagttgttttttgaggtttgatttttatttaggtggtagattttatgttttagatgttatatattttagggttgggggagtgttttttttataagttttatttagtttttggggtgggggagttgtagtttttattagatggggattgtgtgtgttttgtttgtgtttgagggtgatgtgtgtggaaggtgtgttggagatagggtagaggtaagtggggttggtggtttagtttatagtttttttttttttttgtagaaataggttaggttggttgggttttttttttttttattttttttggggtagttggttttgtttattagttttttttttagagttaggatggtagttttttttttgaaggttggttagggtagtagtgttaggatgtttggtgggaatttagtgttttgttttgttttggatgaaaatatagaggttgtggtggaggggtggagtgtggggttggttgttagggtttggtgttttatggtagtggattgtgtgttatttataggtttttttttttagtttttggttgtgtaggtgtgttatggtttggaagttggtaggaggggtttgttaagttggtttgtggagtaattgttgggtgggttttttgggga

SEQ ID NO: 279 - DNA, 2351 bp, Artificial Sequence
  chemically treated genomic DNA (Homo sapiens)
tttttaaggagtttatttagtagttgttttataagttagtttggtaagttttttttgttagtttttgagttatggtatatttgtgtagttaggggttgagggagggggtttgtgggtgatatatagtttattgttgtggggtattaagttttggtggttagttttgtattttatttttttattgtagtttttgtgtttttgtttgaagtggggtaagatgttggatttttgttggatgttttggtgttgttgttttaattggtttttagagggaaggttgttgttttggttttggggaggggattggtggatggggttaattgttttagggagggtgggagaagggagggtttagttagtttggtttgtttttatgaagaaggaaggaggttgtgaattgggttgttagttttgtttatttttattttgtttttagtatattttttatatgtattatttttaaatatgagtaagatatatatagtttttatttagtgggggttgtagtttttttattttaggggttagatgggatttgtggagaggatatttttttagttttggggtatgtggtatttaggatatggggtttgttatttaggtggggattaggttttaaggagtagttttgatgggggtgttgattggtatattttttttttgtatagaggtttttagttgtgttatgagggtgatggtgatttagagagtattttggtggtgttaattttttatttgtttatttggtttataatagttttggaaataataagtttttgttaagtattgagtttgtaaatgtggggttgtagtagtttttattttattggttttattgttttggttttagtaggggggattttgtttttgaattgtttttattttgtttttggtttttaggtttaggtggaggaggttgtaggttttttattagttgagttatagttttggtttgggtgttttagtggttatttttgtttttggaaagtttagttggaagtttgggttatttttggagttgttattatttggttttttataagatttaatttagaggattaatttatttgaattgaggtttggagtggggtttttagggaaatataaatgaaattatatttttagatgtatatttggtggtggtttttgaaatgttgggttatggggttatttttattggtttggttgttgttttgtgtttagtttgaatattaatttggtaattatgattttgtttttgtttaattttatagttttttgatttggttagtattgtggggaggggaggatttgttggttggagtgttggttttattgtttttgatttgggtaatggattatggtttttggggaagtttatatttgtttaaaatattgtttgatgaaatgaaattttttagtggattttgtttttttgtttagggtaggtagtgtgattttgaatttgttttagttattttggggggtttgggataagtggttttagttgtggagtttggaaggaggggtttttagtgtttggttaagtgtggatagagggttgaggtttggtagttattttttatggggtttttttttattaaagatttttgggaaaaggaagttagtgtttggtgtttttgttgggtttggttttttggttttttggttagatggttgttaggtattatttttggttttgagtggatttggttttgggttattttttttatttggtagaggtggagttggtggagagttggggttttttggaagtttttagggttgtgtgggtgtgttgagtttgttttttgtttgtagtgaaggttttggtgttagtgtggttggtttttttttttttgttttagtttagggtttattttgggtgagggtttgatttggtggtttatatgtagtttggtggttttgattttgagtaggtttgtggtgtatatatagaattgaatttgaatatgtatatgtatattttatgtgtggagggtttgtaatgttgtgtatagatagtttttttgtgttggtggtgaaatgtttggttttgtttgtattaagaggggttagaggttatgggaggttgaggttgagggtatttggtagtggagtgtggtgggaagggggtgttttatttaggggttgggaatggttgatggtggggtgtaggagtgtttggtataaatttgggagttgtttttttttggtgtatagagtgtggggtttatggttgtggggtagttgttgggatgagttgggtgggttttgagttgagggagtggagttttggaaaattgttgtgagttttgtgtgtatttggtttatgtttgggggtttggttttgggagttgtgaggttggttt

SEQ ID NO: 280 - DNA, 2427 bp, Artificial Sequence
  chemically treated genomic DNA (Homo sapiens)
ggtatttttggtatttttaagttatttgttttttagtttttgggtttaggattagattagtgttaaaatagttgtttttgggaggggttggatttttattgtgggtagagagggtttttgttttttggggtaggaggggttattttggtagggtaaaaagagataaatagaaaaataatagtaataataatagtaataatttggggttgttgttatggggtttgttttgaataggttgtgtttagtttattgtgaggaaggatgtttagttaggttttggttgaagtttgtagttgggttggatatagtagttattggtttgtgttgtgggggatttgggtttgttatggttgtagtggggattttgtttgagatagatagagttggggtggtgattaatattgttggggtatttttgtaggaattgggtttggtgaattgtttagggatggggaaggagtagggtgaggtatggggattttgatataggttgagtagtgggagaggaggttgaggaggggaaggagggggtttgtagagtagtttttagattttaagtttggttagggataagtttgttagttttaggtttatgttataatttgtagggtttttaagtttaagtttttttaaatttaatgggtaaattgagatgtaatataaataggtttttgattttggtgtttgagttttggatttgaagttttttatggtatttattgtgagttttttttagatgtattgtatgaagtgagtttgttagttttttttttaagaaatgtgttaggttgggtgtggtggtttatgtttgtaattttagtattttgggagattgaggtgggtggattttaaggttaggagattgagattattttggtgaatatggtgaaattttgtttttattaaaaatataaaaaaaaaaaaaaaaattagttgggtttggtggtaggtatttgtagttttagttatttgggaggttgatgtaggagaatggtgtgaatttgggaggtggagtttgtagtgagttgagattgtgttattgtagtttatgttgggtgatagagtgagatgttattttaaaaaaaaaaaaaaaaaaggtgttaaaattttaaaaaattttaagataaagtaagtgtgaaagtaagatttttaaattatttatggttttggttggaagtagtttttgttttgtttggtaggaatttgggagggtgattggttttttgtagaggtgttgtaggttgggtttgttttgtgggtagatattgagtttaggggtttttttagttggggttatttttgtatttttaggtgtgttggtttagtatgttttgtttagtggaggagttgagatgattagatagagagttttgttttggtttgggagtagtttgtggttaagtttgttttattgagtttatttttgggagtagtttgtggttgagtttgttttattgagtttatttttgggagtagtttgtggttgagtttgttttattgagtttatttttgggagtagtttgtggttgagtttgttttattgagtttatttttgggagtagtttgtggttgagtttgttttattgagtttatttttgggagtagtttgtggttgagtttgttttattgagtttatttttgggagtagtttgtggttgagtttgttttattgagtttatttttggtgtttttggtgtgggtttttttttttttttttgtggagaggagttttgattttttagggattttagatttattttgatgtagttattgttggtggagtagggagagattttggggtttgtagatgttgaggggttttttttgtagaggggttttggttattataggttagtttggaggtttttagttttgggggttggttatagtttagatgttttttttttgttttttttatatttatttttattttttttgtttggttttaggtgatttagggtttggttattgggtagttgagtagttattttttggaggaggtgttgttttgggttagtgtgttggtttttattgtggtgggtttggttatggtgagggttttttgttttgggtttatttatttgatttttttattgggtaaggttatttgggtggtattatttgtgtttaagtttttggggatttttttagttttttatatttatttggggttagttttttagtagggatagtagttagggtggggagggataggtaagattttagagaggagtttggttttgtgaggtttttatttagtttggtttttgtttgttgttttaggtttggatgtttagtgttttttatttttgttttttggtgtttggtttggtgtttagtttttgtatttttaatgtggttattgatagtatgttgattaaggttgtttttattttggatataggtgagtgtggttagtgagtggag

SEQ ID NO: 281 - DNA, 2427 bp, Artificial Sequence
  chemically treated genomic DNA (Homo sapiens)
ttttatttgttggttatatttatttgtgtttgaggtggagatagttttgattagtatgttgttggtgattatgttgagggtgtagaggttgaatattaggttgggtattaggaggtagaagtggaagatgttggatatttaggtttgggatggtaggtgggggttgagttgagtgggggttttatgggattaggtttttttttggggttttatttgtttttttttattttgattgttgtttttgttgaagagttggttttgggtgggtgtggggggttggaggagtttttaagggtttaagtatagatggtattgtttaggtggttttgtttagtgagagggttaggtgagtgggtttaaagtggggagtttttattatggttaggtttattatgatgaagattagtatgttggtttggagtagtattttttttgagaagtggttgtttagttgtttgatgattaggttttgggttatttagagttagatagagagggtagaagtgggtatgggggaggtgagggaggggtgtttggattgtggttagtttttaaagttggggatttttagattggtttgtggtggttagggtttttttgtagagaaggttttttagtatttgtaagttttggggtttttttttattttgttagtagtgattgtgttaggatgggtttgagatttttgaggagttggggtttttttttataagggaggaaggaaaggtttatattagggatattggggatgggtttggtgggataggtttggttgtaggttgtttttggggatgggtttggtgggataggtttggttgtaggttgtttttggggatgggtttggtgggataggtttggttgtaggttgtttttggggatgggtttggtgggataggtttggttgtaggttgtttttggggatgggtttggtgggataggtttggttgtaggttgtttttggggatgggtttggtgggataggtttggttgtaggttgtttttggggatgggtttggtgggataggtttggttgtaggttgtttttaggttagggtgaggttttttatttggttattttagtttttttattaagtagggtgtgttgggttaatgtgtttgggagtgtaggggtggttttggttggaggagtttttgggtttagtatttgtttatagggtaggtttagtttgtagtatttttgtaggggattagttatttttttaaatttttgttaggtagaatagaaattgtttttaattggaattataaatggtttaaaaattttatttttatatttgttttattttagggttttttgggattttaatattttttttttttttttttttgagatggtgttttgttttgttgtttagtgtggattgtagtggtgtgattttggtttattgtaagttttgttttttgggtttatgttatttttttgtgttagttttttgagtagttgggattataggtgtttgttattaggtttggttaatttttttttttttttttgtatttttggtagagatggggttttattatgtttgttaggatggttttaattttttgattttgggatttgtttgttttggttttttaaagtgttgggattataggtgtgagttattgtgtttggtttaatatgttttttaaaggaagagttggtaagtttattttgtgtagtgtgtttaagaggggtttatagtgagtgttgtgaaggattttagatttaggatttagatattaaggttagaagtttatttgtgttgtgttttagtttgtttattaagtttaaaaaagtttgaatttaggagttttgtaggttgtgatatgaatttggagttaataagtttgtttttgattggatttggggtttgggggttattttgtgggtttttttttttttttttttagtttttttttttgttgtttaatttgtgttggggtttttatgttttattttgttttttttttgtttttgggtagtttattaggtttagtttttgtgagggtgttttgatggtgttggttattattttagttttgtttgttttaggtagggtttttattgtagttatggtaggtttaagttttttataatataggttaatgattgttgtgtttagtttagttgtaggttttagttagggtttggttaagtgtttttttttgtagtgagttgggtgtagtttgtttagaataggttttatggtaataattttggattgttattattattgttgttgttgtttttttgtttatttttttttattttgttagggtggttttttttgttttaaaaagtagaggttttttttgtttatggtgggggtttagttttttttaggagtagttattttagtattagtttagttttgggtttagaggttgaagagtagatggtttggaggtgttaggaatgtt

SEQ ID NO: 282 - DNA, 2501 bp, Artificial Sequence
  chemically treated genomic DNA (Homo sapiens)
tttatatatattatgttttttaaatgatatattagttttttgagggtaatttatattggtaatagtttttagatgtggaaattgtgaagataatgttggtgatgtggaagtaatataaattttggagttttttagatttaggtttgaatgttagattgttttttatttagagtaattttagagtattattttttattttaatttttttttaggtttttttgtgtttatgtgttttttttatttttgtttattgtttatttagtgatttttgtatttttttttattgttagtgtgtagatatatagtttttttggttttgagatttatgttaattttattttattattttgttagtttatttaatttttattgagtaatgttagttgaaagttgtggtgggattaaatgttgtaatgagtatttaaatgaggttgaagtatttatgtattttatttatatatggtgaggtatatttaaggaaggttgtagttattaaaattttaggaaataattttttatttttttaggtgaaagggtttttaggtttttgtgttttggaaggtttatttatagttattttttaaatgataatgtgattgatgagtttagagtttagtttaaatagtaatggattggaagattagtttaggttttattaatgtggaatatagaataaattatgtttttgttttagtttgtttatttgtgaaatagagtttattatatttagttttttttgtttttaggtttgagttattttttttggttaaggtaagtaaatgtttatgatgtttggttgtgtataagataaagttataataaagttataatttattttttttttgtagaagattgtaaaaagtaaaagagatttaggtaaaaattttggaatgatttttggaatagagagtttttttagaattagaagttaaaggaatttaaaatatagggaggtttagggtttttattgatataaaggaaagatgttttttttataggtttatgtttatattttttttttttttttatttttatttgtatttttatttttatatagggtttatgggattttttttataaaagagtagttgtagtaatttatattattttttatgtttggttgtttattaagaggtgaaaagtagttttatataggttttatttttggatagttttagttgtaaagtttaaaatatgtgaaggtaatttggaaaagtaagtggttgtatataaagtaaatgtttatagagttttggataaaattgagtgtttatgtgtatatggtaagtgtttttagtgtttgtgtgtttatttgtttgtttgggtgattttgtttttgagagtttggatgagaaatgtatggttaaaggtaattttagataggaagaaaggtagagaagagggtagaaatgatttttgatttttggggttgagggtttttagagtaaatggtataatgttatgaggtttgatttatttttatgatggaatttaaggttttagtaagtatttgttggtttggttatggtttgttttttagtttgtaggagatttttttatttttttatttgtgtgtttttattagttttgaaaagaatttttggtagttaggagtaggtatttttattgtttttttttttttttttttgtttttattttgttggttttttagattgggttttggaattaaatttggtgagtgttggtttttaggaaatttggagttttggtgtttaaattttggtttaggaaagtaggagttatttaggaagtaggggttttttagggttagagttagttttttttgtttttgtttatgttgtgttagtatttgtttttttaaagttattaggtaggtgttagtgtgtggtgaggggaggggagaaaaggaaaggggaggggagggaaaaggaggtgggaaggtaaggaggttggtttggtgggggtgggatttgatttgtaaattgttgtatttgttttttattttttagtgttttttttgagattttggggagttagtttgttgggagagtgggatggtttggagtaagtttagaggtagaggaggtgatagagggaaaaagggttgagttagttgttttagtgttgtataggagttgaagggatgtattatgttagttttagtttggttttagtgatagttaatgttttttgtagtgtggtggttttgaagttgttgtttggagttgtttttttttttttggtgaagtttttaaaagttgttaaagatttggaggaagtaaggaaagtgtttggtaggattgatggttgtttttgttttttttttttttattttgtttttttttattttgtttttttttttttttttgtttttttttttgtagttgttttagttggttatttttagttaattttttttattatttttttttttatttgtttttttgtttttgttggtttagtgttgttagtttgagtttgtagagaggtaattttttttggttgtgagtgggtgagtt

SEQ ID NO: 283 - DNA, 2501 bp, Artificial Sequence
  chemically treated genomic DNA (Homo sapiens)
agtttgtttgtttgtagttaaagggagttatttttttgtaaatttgggttggtagtgttgggttgatgggggtgggggggtgggtggggagaagggtggtgaggggggttggttgagagtagttgattgaggtagttgtgggagagaagatgggggagggggggaaggtagggtggggggaggtggggtggagaggaggaggataaaggtagttgttagttttattaggtattttttttgttttttttgagtttttagtagtttttaaaaattttattgaagaggaaagggtagttttgggtggtggttttgaagttgttgtgttgtaagaggtgttggttgttgttggagttgggttggggttggtgtggtgtgtttttttggtttttgtatagtattggagtggttagtttggttttttttttttttgttgttttttttgtttttgggtttgttttggattgttttgtttttttagtaagttggttttttgggattttggagggggtgttgggaggtggagagtaaatgtaatagtttgtgagttgggttttgtttttattgggttggtttttttgtttttttattttttttttttttttttttttttttttttttttttttttttttattgtgtgttaatgtttgtttagtggttttggagaaataagtgttggtgtagtgtgggtgagggtaggagaggttagttttagttttggaggatttttgttttttgaatagtttttgtttttttaaattaaggtttaggtgttagggttttagattttttggaggttagtatttattaaatttggttttaaagtttaatttaaaaaattaatagggtggaggtgagggagggaggaaaaggatgataggaatatttgtttttggttgttaggggttttttttaggattgataagagtgtgtagatgggagagtgggagagttttttataaattgaggagtaagttatgattaagttagtagatatttgttgaaattttagattttgttatagggatagattgggttttgtggtattgtgttatttgttttaggaatttttagttttaagaattagaggttatttttatttttttttttgtttttttttttgtttggaattgtttttaattatgtattttttatttagatttttaaaggtaaaattatttagataagtaggtaaatatataaatattaaaaatatttgttatgtatatataggtgtttaattttgtttagagttttgtaaatgtttgttttgtatgtagttgtttgtttttttaagttgtttttgtatattttaaattttataattggaattatttaaggatagaatttatatagggttgttttttgttttttgatggatagttaggtgtagaggatgatgtgggttattgtaattgtttttttgtggaggaggttttataagttttgtgtaaaggtggagatgtaagtgggaatggaaagagagagaaaatgtaaatgtaaatttataaggaaaatattttttttttatgttagtagagattttgggtttttttatgttttaaatttttttgatttttgattttggggaggttttttgttttaaaagttattttgagatttttgtttgggttttttttgttttttgtagttttttatagagaaaagatgggttgtagttttgttgtagttttattttgtgtatagttaaatattataggtatttatttattttgattaaagaaggtaatttaaatttaaaggtaaggaagattggatatgataggttttattttatagatgaataggttgaaataaggatataatttgttttatgttttatattagtaaaatttaaattagttttttagtttattgttatttgagttagattttagatttattaattgtattgttatttgggaaatggttataaatgaattttttagaatataaaggtttgaagatttttttatttgaggaggtgaaaaattattttttgagattttaatggttatagttttttttgaatatattttattatatgtaagtagaatgtgtagatattttaattttatttgaatatttattgtaatatttaattttattataatttttaattagtattgtttaataggaattgagtgggttggtaggatggtagaatggaattaatataggttttagagttaggagaattatgtgtttatatattaatagtgaaggaaggtgtaaaaattattgaatgaataatggataggagtgaagaggatatatagatataaagaggtttgaaaaaaaattaaggtgagaaataatgttttgaagttattttgaataaaaagtagtttgatatttaaatttgggtttgaaagattttaaagtttatgttgtttttatattattaatattgtttttatagtttttatatttgaaaattgttgttaatataagttatttttagaaggttagtgtgttatttaaaagatataatgtgtataga

SEQ ID NO: 284 - DNA, 3190 bp, Artificial Sequence
  chemically treated genomic DNA (Homo sapiens)
aggagtttaagattagtttggttaatatgatgaaattttgtttttattaaaaatataaaaattagttagttgtggtggtgtatgtttgtaattttagttatttaggaggttgatagaggagaattgtttgaatttaagaggtgaaggttgtagtgagttaagaatatattattgtattttagtttgggtgatagagtaggattttgttttaaaaaaaaaagagttggttagtgttaaatgtttagtatagagattggtatagtaatttttaatgtttagtatttattgttattattttttttttttttttttttttgagatagagttttgttttgttgtttaggttggagtatagtggtgtgattttggtttattgtaagttttattttttaggtttatgttatttttttgttttagttttttgagtagttgggattataggtgtttattattatgtttggttaattttttgtatttttagtagagatggggttttattgtgttagttaggatggttttaattttttgattttgtgatttgtttgttttggttttttaaagtgttgggattataggtgtgagttattatgtttggttttattgttattatttttattttttatttttgtatagagtatttatggtttaagaaatatttgttattttaattgtatgggagttttataatagtatagggagatatttttgattattatttttattaggagggtggagaaattgaggttttgggaggtggttttgatttagggaattaatttgttgatttattaatttatgaagttttatagttaaaaaagattagattaaaaaatgagaatttagtaaaggggttgaggtaggaggattgtttgagtttagaaatttgagattagttttggtaatatagtgagattttttttttagaaaaattttttaaaaaattaggttgtttgaggtagagtgtagtggtttatgtttgtaatttaatattttaggaggttgaagagggtggattatttgaggttaggagttttagattagtttggttaatatggtgaaattttgtttgtattaaaaatataaaattagttggtgtggtggtatatgtttgtagttttagttatttaataggttgagataggagagttttttgaatttggtaggtggaggttgtagtgagttgagattgtgttattgtattttagtttgggtaagatagagtgagattttgttttaaaaaatataaataaaataaataaataaaaaattaggttgttagtttagtggtttatggtttatatttgaaattttagtattttgggaggttaaggtaggaggattgttttagtttaggagtttgagattaggttgggtaatatagggagatatagtgtttttattgtttttgtttgttttgatttgtttttttataaaaaggtaaaagaaaaaaaaattagtttggtgtggtggtgtgtatttgtatttttagttattagagaggttggggttagaggattgtttgagtttaggagtttgaggttgtagtgagttgtgattgtattattgtattttagtttgggtgaaagagtgagattttatttttaaaatgaataaataaaaaattttaaaaaataaaagaatttagttaagtgtaaaagttttttttgattttaggttttagtgagttattggtggggttgggatttgaatttagtggaattagaattgtgtaggttttataatttatttagattttagtaattttaggttagagggttattgtgtttatgtgaggttgggtgggtgggttgttagttttgttttggggaggggtttgtgttgttgattggttgtggttggtaggtgaatttttagttaattagtggtatggggggtggtgtttttggggtttatttggttgtagttatgtatttttttttagtggtgttggaattgtaaagtatttgtgagtttgtggaagttagtttagattttagtttgttttagtttggtttgatttgattgtatttggtgtttgtttttgtttggtgtttttggttagttatgggtttttggagttgtagttttttggtgttgttgttgttgttgtaggtattttggattttttgatttgtgagggatgtatttgggttgtaagttttgtgttttagttttgtgttttttttttttttgttgttattgtttttttttttttaagaaagtttgggttttgaggagtggagtggtttggaagttttgtgtgttttggattttttagtgatgggagtggggggtgggtggtgaggggtgagtgtggtttttttgttttttttagtgtagattgaggtgggggtgtttggttgtggagtttgtggggtgggtttgtgtgggtggtgggggtgtgaagtggggtgtagggggtggggtgtggagaaggggtgttttggtgtaagttgagggggagttaggagttgtggggatgatttttgagggaaggagaggggtatttgtagaaataaaggtatttgttatgttaagaaaggttgtaaataggagtgagggttttggggataagaaagtgaggttggaggaggtgggagtgttttttgttttgaggagtggtgtatttttggtttaaggaaagtggggtattggagaataaagatatttttaataaaatgagaaaggagattgaaagggaatggtgggttaggttttgagggggtgatttggtggtttttttttgggagtttttgggggtttggtggttgtaggttttggggtgggggagggtgatgttgttgtttgtttgttttggggttgtgggttggggtttttttttaattttgatgttgggagtgagggaggggtggtgttgttggttttggtgagtaggagggaattttttgagttatttggttttatttattttttttttattttaggtttttttttggttttgttaggagttggagttttgttattttggttttgatgttgagagttatatgtttatggtgttttggtgttatttggagagaggttgtgttttgggtagaggtgagggtgtgttgttggtgtttttgggtggagtagggaggggttggaaaggggttgagaaattgtatttttatatttttgggttgtaatgggtaagttttttttttggtttaaatgatattttttggaa

SEQ ID NO: 285 - DNA, 3190 bp, Artificial Sequence
  chemically treated genomic DNA (Homo sapiens)
ttttaaggggtgttgtttgagttaaggagggagtttgtttattgtaatttaggggtgtgggagtgtaattttttggtttttttttaatttttttttattttgtttagggatattggtagtgtgtttttatttttgtttaggatgtggtttttttttaggtggtgttggggtattgtgaatgtgtagtttttggtgttaaagttagggtggtagggttttggtttttggtagagttaagaggagatttggggtgggggaaaggtagatggaattgggtgatttggagggtttttttttgtttattgaaattaatagtgttgttttttttttgtttttggtgttgggattgggggaggattttagtttgtagttttgggatgggtgggtagtgatgttatttttttttattttgaaatttatggttgttgagtttttaggaatttttgggagggggttgttgagttatttttttaagatttagtttattgtttttttttagtttttttttttattttattggagatgtttttattttttagtattttattttttttagattgggaatgtattattttttagagtgaggggtgtttttattttttttgattttatttttttatttttgggatttttatttttatttatgattttttttggtatggtaggtgtttttatttttatggatgttttttttttttttttgaagattgtttttatgatttttggtttttttttgatttgtattagggtattttttttttatattttattttttatattttgttttatgtttttattgtttgtgtgagtttattttgtggattttgtggttagatgtttttgttttggtttgtgttggagggggtaggaaagttgtgtttgttttttattatttattttttatttttattattggggggtttggagtgtgtgaggtttttaggttgttttgttttttaggatttgaatttttttggaagaagggaagtggtgatgatgggagaggaaggggtgtagggttggggtgtggagtttgtggtttgaatgtgttttttgtaagttaggggatttggggtatttgtagtagtagtagtagtgttgagaggttgtggttttaagggtttatggttggttggggatgttgagtgagggtaggtgttgggtgtggttgggttgggttgggttggagtgggttggagtttgaattgatttttgtaagtttataggtgttttgtagttttgatgttattgagagggggtgtgtggttgtagttaggtgagttttggaggtattgttttttgtattgttgattggttgagggtttatttgttggttatagttaattagtagtgtggatttttttttagggtggagttgatggtttgtttatttggttttgtatagatgtggtgattttttagtttggagttgttagggtttaggtgggttatgggatttgtatggttttgattttattgggtttgaattttagttttgttggtggtttattaagatttgggattagaaagggtttttatatttggttgagtttttttgttttttgggattttttgtttgtttgttttggagatggggttttatttttttatttaagttggagtgtagtggtgtgattatagtttattgtagttttgaatttttgggtttaagtggttttttggttttagtttttttagtagttgggagtataggtgtatattattatgttaggttaattttttttttttttgtttttttgtagagagataagttggggtggataggggtagtgggggtgttgtgtttttttgtattgtttagtttggttttgaatttttgggttgaagtgatttttttgttttggttttttaaagtgttaggattttaggtgtgagttatgagttattgagttagtagtttaattttttgtttgtttgttttgtttgtattttttgagatggagttttgttttgttttgtttaggttggagtgtagtggtatgattttggtttattgtaatttttgtttgttgggtttaagagatttttttgttttagtttattgagtagttgggattataggtgtgtgttattatattggttaattttgtatttttagtatagatggggttttattatgttggttaggttggtttggaatttttgattttaggtgatttattttttttagttttttgaagtgttggattataggtgtgagttattgtattttgttttgagtggtttaattttttaaaaaatttttttagagaggggattttattatgttgttgaggttgattttaaatttttgaatttaggtgatttttttgttttagtttttttattgagtttttattttttaatttagttttttttaattgtagagttttatgggttagtgagttagtaaattgattttttaggttaggattattttttaaagttttagtttttttatttttttaatgggaataatgattagaaatgtttttttatgttgttgtgggatttttatataattaaaatgataaatgttttttgagttataaatgttttgtatagaagtgaggggtaaaaatagtaataatagggttaggtatggtggtttatgtttgtaattttagtattttgggaggttgaggtgggtagattatgaggttaggagattgagattattttggttaatgtagtgaaattttgtttttattaaaaatataaaaaattagttaggtgtggtggtgggtgtttgtagttttagttatttgggaggttgaggtaggagaatggtatgaatttgggaggtggagtttgtagtgagttgagattgtgttattgtattttagtttgggtgatagagtaagattttgttttaaaaaaaaaaaaaaaaaaaaaatagtaataataggtgttggatattgaagattattgtgttagtttttgtgttaagtatttgatattgattagtttttttttttttgagatggagttttgttttgttgtttaggttggagtgtaatggtgtgtttttggtttattgtaatttttgttttttgggtttaagtggtttttttttattagttttttgagtagttgggattataggtatgtgttattatgattggttaatttttgtatttttagtagagatagggttttattatgttggttaggttggttttgaattttt

SEQ ID NO: 286 - DNA, 2613 bp, Artificial Sequence
  chemically treated genomic DNA (Homo sapiens)
gaatggggaagtttttattggtggttatttttttttttttttagtttgggttagagatgaattatttgtttatgaaattatattaaataaaataagtgttgaatgtgttttggattttttgagggttttttttatttggttttttaggaagtggttgttgttttagatgttggttttttagtagtattagtatgagggttatagtggtgggtgtttttggtgttgtttatttttttgtgagttgtgggatgtgaattatgaaaatttttatttgtggtgggttgtatgtgtgttgaatttggagggttattaagaatttgtgtattatgtttttgttgtttttagggttgagtttggtagttgttgtgttgttttttggtattagaggtgagtagtgttatttttgtttttttaattgtagattgggatttatgtattgttttttgtttatttttgttttgtaggtgtgtatttgttttttttgagtgtgtttgttttttatttttatttttatttttattttatttttatttttatttggatttttaagattttggaatggttttgagttttgtgtatgtgggaagggttgttggaggtgtttgtagggaggtgtgtgtgtgggtggtttagggtttgtgttttttttttttttgtttattgttatttttttgttttgtgtgtgtttttatttttattattatttttttatttttagtgtgggtgttttgtggtgatggtttaggggttggatgtttggaatgtaattttaggtagtttgttttttagttatatttgttatttgatatggttttattaggaatagttgtgtttttgtggattttggtgttgtttgtgtttttgtttttttattttttttattttatttttggttttttttgttgaaagttttttattttttaaattagattatttaaaaatgaaaaaggaagaaaggaaagtgaggttattttattgttttatttgttaattaggaggttgaatgttagttttgaattaaaagttgttttgttttttttttagatttggaaaataagtgaaattaaattaaattgttgtatgtttttgatgtgatatttggatatggtgtggtgttggtgttgttggagttgttgatttggtttggtgttggattaggtaggtggagttgtatttgggggttttagttgggtttgggtgtttattttttttttagttgtttgtgttgttgagggtgtttggttgggataagtattgagttttttgtgtttagtttatttttatttttggttttaatttttatgatagttgtggagtatttgagtgttttttttttttttttttttttttgtgttttttttttttgttggttgttttttttttgttgttgtgtttttgtgtagaatggttgttttggtgattgttggttgttgttgtttttatgttttgttttgtgtttagatattttgattttttttgattttgttgtttgattttttggtgtatgttttttttttggtttttttttttatgttttttttttttttttttttttatattattgattttttttggatttttttttttttttttttttagttgggagataggaaaagtggttttgtttgggaatagtaaaagtagggtaaggaaaggaaggagtggtagaaaggaggggtgagttgaggatataggggtagttggagaatgtggaggagttgggttttgagtgtggtttaagtgaggtttggtttttgtttaggaatttggatgtgggtttgttggttttttgtgtgtgggaagttgagtttaggatgttgtttttaggttggtgtgttgatttggtgttttgatttggagtttgtggtttgtttggatttgttttaaattttgtgggttggatttgtggtttgagtgggtgggtgtgtgttagaggatttgggattaggtttagttttgggaatttggaaatgtggtttgttttttagtggttttttgtttatgtgtttgggtttagtggtttagttgaagaagtggaattatagtgtgagttgatagggttttatagattagatgttaagttttttagattttataggggaggaaagtgaggtttgtattggttgagttatttatttaaggtggtgtggtagtttagaggagtggtagatttttttttttttattttttgttttattatttgatgttgttgttggattttggtataaatttaagataaaatggggttttttggaaaaagtgagatttagtgattatttttatgtagttattttaaatatttatttagatatttataaatgtatttttttggtaggtagattttatttagaatttatttaatattgtgttttgtgttggggttatatgttatttttttgtttagtatggttgttttttttttttttttgtaaatatagtttttttttttttaggttttttttgaagtaagtagtttttttttagaaatgtttttttttttaggtatttttatattattgtgatttttttttttatagtatttaggatgaagagattattttatttatgtatttgtttatttgtttgttgtgtagaatgttagttttatgggaa

SEQ ID NO: 287 - DNA, 2613 bp, Artificial Sequence
  chemically treated genomic DNA (Homo sapiens)
tttttatagagttgatattttatataataaataagtaaataagtatataagtaaaataatttttttgttttaagtgttataaagaaaaaaattatggtggtatgagggtgtttgaaaagggaagtatttttgaggaagggttatttattttagaagagatttgaaggaaaaagagttatatttgtgaagagggagaaagagtagttatattagatagaaaggtggtatgtggttttagtataaagtatggtgttgggtaaattttgagtgaaatttatttattggggaggtgtatttgtaaatatttagatagatatttagagtggttatgtaagagtgattgttaaattttattttttttaaagggttttgttttgttttgggtttgtattgaggtttggtagtaatgttaagtgatggggtgggggatggggaaagagaagtttgttgtttttttaggttattgtattgttttaagtgggtggtttggttagtgtaggttttattttttttttttgtaaggtttggggggtttgatgtttgatttgtaaggttttgttggtttatgttgtggttttatttttttaattaggttattaggtttaagtgtatgaataggaagttattgagaagtgggttatatttttaggtttttggagttgggtttagttttgaattttttggtatatatttatttatttaggttgtgggtttagtttgtgaggtttaggatggatttaggtagattgtaggttttgggttggggtattgggttagtgtgttggtttgaaggtggtgttttgggtttgattttttgtgtgtggagagttggtgagtttgtgtttgagtttttggatgagagttgagttttgtttagattgtgtttaggatttggtttttttgtattttttggttgtttttgtgtttttgatttattttttttttttgttgtttttttttttttttgttttgtttttattgtttttaaataggattgttttttttgttttttagttggaaaggaggaagggagagagtttagaaaggattggtgatgtggaagaaaaggggaggaggggatatggagggggagattggagagagaatgtatgttgaggagttaggtggtgggattaaggggagttggggtgtttgggtgtggggtagagtgtggaggtggtagtggttaatggttgttaagataattattttatgtgaggatgtggtgataggaggggagtggttagtaggggaggggagtgtgggggaagaggaaagaggaagaagtgtttagatgttttgtggttgttgtgaaggttaaaattgaaaataaaaatgggttagatataaaggatttggtgtttgttttagttaggtgtttttggtgatgtgggtagttgggaggggaatgggtgtttggatttagttgggatttttgggtgtgattttatttatttagtttggtgttaggttgggttgatagttttggtagtgttagtgttgtgttgtgtttagatgttgtgttagaggtgtgtagtggtttagtttaattttgtttgttttttaaatttagaagaggagtggagtggtttttagtttaaaattgatatttagttttttgattggtggatagagtaatgagatgattttgttttttttttttttttttttatttttaaataatttagtttgaagaatggaagatttttgatgaggggagttaggaataaaataaggggaataggggagtggggatgtgagtagtattagaatttgtgggagtgtggttgtttttggtagggttgtgttaggtgatggatgtagttagggggtgagttgtttggagttgtgttttaggtgtttggtttttgggttgttattgtggggtgtttgtgttgagggtgggaagatggtggtgggggtgggggtgtatatagggtgggaaagtggtggtaggtgggagggagaggaatgtgggttttgagttgtttgtgtgtgtgtttttttatgggtgtttttggtagttttttttgtgtgtgtagggtttagagttgttttgagattttggaggtttgggtgggagtgggggtggggtgggggtgggggtgaaggtggggggtgggtgtgtttagggaaggtgggtgtgtgtttgtggggtggagatgggtagggggtggtgtgtgggttttagtttgtagttaagggggtaggagtggtgttgtttatttttggtgttaaagggtggtgtagtggttgttgagtttggttttggaggtggtgagaatatggtgtgtaggtttttggtgattttttggatttggtgtgtgtgtggtttgttgtgagtgagggtttttgtggtttatattttgtggtttatgggggagtgggtagtgttaggggtgtttgttgttgtggtttttgtgttgatgttattgaggagttagtgtttagggtagtagttgttttttagaagattaggtaggaaaggtttttgaaaagtttggggtgtatttggtatttgttttgtttggtgtgattttgtaaatagataatttgtttttagtttaggttaggaggaggaggagataattgttggtggaggtttttttattt

SEQ ID NO: 288 - DNA, 2501 bp, Artificial Sequence
  chemically treated genomic DNA (Homo sapiens)
tgttattatattgtattgtttgtggatgatttatttgtttttgtagttttatttgaagaatttttttttttttttttttgaggtttgttttaaatattattttttttgtgaagattgtttggtgttttttaggagagagtgtgatttttttttttaggaatggtagtattttaaatatatatattttgtagtatattttattttgtatggtaatggtttgtttgtgagttttattttgtattagagggtgagggttttgaagatagtgttaggttttatttattttgatattttataatatttattatatgtttgatgaatgaatgtatagggggatggttgggtgtattttttttaattttttaattttttgaaataaataataaaattttatttttttttagaagttttggtatggttttttttattttgttatagttattgataattatttttattttttgtgtaatttattaggtaagaagtttatgtagatttatttttagtagtttatatgataaataaatattgtgtttgatttttaaatattaaattatagtatattatagatagatatagagttattatttaaagtatgatattttaattttaaaaggttttttttgaagaatattataaattttttttttttttaagatttgttgggtaggaaagatgggagaaaatgaattaatgtttatatagaaaggaggataatgggggtaaaaataatagatgaatgtatgggtggatgagagaatggataaaatgataggtggatatgttgattttggatagatgggaaatgagtggatatattaataaatagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggatttaagtggttagtggatggataggaggatggatggatgtgagagttttagaaggatataaggaaagatgggtggatagatggatgggtggatggaaggatatttaggaggatgaatgagtatgtgtgtggagagaggtgtttatttatattggtttgaatatatgggttagttgagttaaatgttagttttatgataggttattagtagttttttttgagttgttttgttaagaagttaaaatttatttaagttatgtggatttgttattgaggggaaaaagaatgagttttttttttttttatttggaagatttattaattttttattttttattttttattgtgggtatggaggtattgtgttatttagggtaagattttgttttttttttagttttttttttaggatatttaatattttgtgaaatttagagattttgttttagttggatttagagaaatttagtgggaaaggagaggttaaaggttgaatttaatggtgtaaggttttatggtttggttattttttgttttgatgttgtggggttagtgggagaagaaagttagtgtgtttttgggtgtaggggttagtggggtttggaggtataggtattttgtgatattttaggttttttgatttatgtttttggtagttttgattatttatagttttagtagagtatggggtgggggtagaggggtttgtttgggagggttgttattttttaaaatttttgtgggttgtttagttatagttttttttgtttgggtgtgttttttgtttgttttttttttttgttttaggttattgtttttaattttgaataaaaattgtagttaatttttgaggtagttttattgtttagtggattttagtttttgttaggtttggtttgttatttttgttttgttttttgttggtttttgttttgtgtttagggattttttagttttttttgtttgtgttttttgtttgttttggatattatggataagttttggtggtatgtagtttggggattttgttttgtgttgttgagtttggtgtagattggtgagtgtttgttgtagtttgggtagtaagatgggtgtggggtgtttagtgtggatttggtggtagtttttttggttgagttggttttgggggattggagttaagtgagttgtttgtgaagtgtattgggttttggaaagtagggttgggatttgtgttaaattgttggagaatgtgtttgtggaagtattatttggttgaaagaaaaagagaaagagaagaaagtttgttgggtaggttgttggtgtgtagttttgggtgaggttgttagagttgtagtatatggtagaaagtaattgtttttttggatgtgtatagttgttgtttggattaataggtttttgtgtttaagggtttgttaagttttattgggttgtgtttaggtagggtagagttgggtggggtagagattggggttggaatagggtgagtgg

SEQ ID NO: 289 - DNA, 2501 bp, Artificial Sequence
  chemically treated genomic DNA (Homo sapiens)
ttatttgttttgttttagttttagtttttgttttgtttagttttgttttgtttagatatagtttggtggggtttggtgagtttttgggtataggagtttgttagtttagataatgattgtgtgtatttgggagaatggttattttttgttatgtgttgtagttttagtgattttgtttaaaattgtgtgttggtagtttgtttaataaattttttttttttttttttttttttttaattaaatggtgtttttatagatatattttttaatggtttagtgtaaattttagttttgttttttggagtttaatgtattttgtagatagtttatttgattttagttttttagggttgatttagttggaggggttgttgttgggtttgtgttgagtattttgtatttattttgttgtttaggttgtggtgggtatttattgatttgtgttaggtttagtggtatgaggtagagtttttaggttgtgtgttattaaaatttgtttatggtgtttggagtgaatggagggtgtgggtgaaaggagttggaggatttttgggtgtggggtaggggttggtggaggatgggatgaggatggtggattgaatttggtagaggttggggtttgttgggtaatgaggttgttttggaagttggttgtagtttttatttgaggttgaaaatagtgatttaagatggagggagggagtgagtgaaggatatatttaagtaaggggggttgtgattaagtagtttgtagaggttttaagaagtagtagtttttttgggtgggtttttttgtttttgttttgtgttttgttgaggttgtaaataattggggttgttagggatgtgggttggggaatttggagtgttgtggggtgtttgtgtttttgagttttattggtttttgtgtttagagatgtattggttttttttttttgttggttttgtggtgttaggatagaggatgattgaattgtaaaattttgtattattgggtttagtttttggtttttttttttttgttaaatttttttgaatttggttggagtaagatttttgggttttataggatgttggatattttgggagaggagttggagagagggtgaggttttgttttgggtggtgtagtgtttttgtgtttatagtggggagtgaggggtggggagttggtgaattttttaagtggaaagagggagagtttattttttttttttttaataataagtttatatggtttgaatgaattttagttttttggtagaatagtttagggaaagttattgatggtttgttatagggttggtatttggtttagttaatttatgtgtttaagttagtgtgaatgggtatttttttttatatatatgtttatttatttttttaaatatttttttatttgtttatttatttatttatttatttttttttatgtttttttggggtttttatatttatttatttttttgtttatttattaattatttaggtttatttattattttatttatttatttatttaattatatattttttaatttatttaattatttatttttttatttatttttttatataattttttatttattattttatatttttttttttatatttttttataaaattataattatttattatttttttttttatttatttatttatatatttgtttattgatatatttatttattttttatttgtttaagattaatatatttatttattattttatttatttttttatttatttatatgtttatttattatttttgtttttattatttttttttttgtgtaaatattaatttatttttttttattttttttatttagtagattttaaagagaggaagagtttgtaatattttttaggggaagttttttgagattgaaatattatattttgaatgataattttatatttatttataatatattatggtttaatgtttggaaattaaatgtagtatttatttgttatgtgaattattaaaagtaaatttgtatggattttttgtttggtgagttatatagaaaatgaaagtgattattagtggttgtggtaagatgaaaggaattatgttaggatttttgagggaaggtaagattttgttatttattttaagaaattgaaaagttgagagaaatgtatttagttatttttttatgtatttatttattagatatgtaatgagtgttgtggggtattgaggtaaataagatttggtgttatttttagagtttttattttttggtatggaataaaatttataagtaggttattattatgtaaggtgaaatatgttgtaaaatgtgtgtgtttggggtgttattatttttagagaagggagttatatttttttttggagaatattaggtagtttttataggggaagtgatatttgaggtaggttttaaaggaaaaggaggaggaattttttagatgaaattatagggataagtaagttatttataggtagtatagtgtagtgatg

SEQ ID NO: 290 - DNA, 2501 bp, Artificial Sequence
  chemically treated genomic DNA (Homo sapiens)
ttgttgtatagaatattttattatttaggtattatgttgagtatttaatagtttttttttttgtttttttttttttttttattttgtattttggagttaattatagtgtttgttgtttttttgtttgtgttataagtttttattatttagtttttatttataagtgagaatatttagtatttggatttttgtttttgtattagtttgttaaggataatagtttttagttttatttatgtttttataaaagatatgatttagttttttttaatggttgtattaaatgaagttttaaagatataatataaatattaattttttttttattataaaaattttttgttgaatttgattatatttaaattaatgagttttgttttatgaaagattttttggataaatttgatagttgatggaataggagaagttgtttgttatgtttaaagttaataagagattaatatttagaataaatggagatttgtaaattaatagaaagtaggtagtaaagttaaagaaaatagtttaaggtatagttattaaaaggaatgtgattatgttttttgtagggatatgggtggagttggaagttgttagttttagtaaatttatataggaatagaaaattagtgagattgtatggttttatttataagtgggagttgaataatgagaatatatggttatatggtggtgattaatatatattggtgtttgttgagtggggtgttggggagggagagtattaggaagaatagttaagggatattgggtttaatatttgggtgatgggatgatttgtatagtaaattattatggtgtatatatttatgtaataaatttgtatattttttatatgtattttagaattttaaataaaagttggatggttaggtgtggtggtttatgtttgtaattttagtattttgggaagttgaggtgtgtagattatttaaggttaggagtttgagattagtttggttaatatggtgaaattttgtttttattaaaaatataaaaattagttagatgtggtatgtatttataattttatttatttgggaggttgaagtagaattgtttgaatttgagaggtggaggttgtagtgagttgttgagattgtgttattgtattttagtttgggttatagtgtgagattatgttataaaataaaataaaataatataaaataaaataaaataaaataaaataaaataaaataaaataaaataaaataaaataaaaaaataaaataaaataaaataaaataaagtaatttttttttttttaagtggtttttattttttttttttgttttgtgaagtgggtgtgtaagttttgggattgtagtggttttagggaatttttttttgtgatgttttggtgtgttagtttgttgtgtatattttgttgtggttttttttttgttgtttgtttattttttaggttttgttggggatttgggaaagagggaaaggtttttttggttagttgtgtggtgattttggggattttagggtgtttttttgtggttgatgtttggggtgtagtggttgttggggttggggttggtgggagtttgtgggattttttagaagagtggttggtgttgtgatttagtattggggtggagtggggtgggattatttttataaggtttggaggttgtgaggtttttgttggagttttgttgttgtagtttttgttattagtgagtatgtgtggtttgtgtttttggggatggggtttagagtttttagtatggggttaatttgtagtattaggtttgggtttttggtagggttttttgtttattttgagatttgggatgggggtttaggggatttaggatgtttttagtgttgttagtggtttttagggggtttggagtgttttggggagggatgggattttgggggtggggagggggggtagattgtgtttattgtgttttggtatttttttttgggttttagtaaatttttttttgtttgttgtagtgttgttttatattgtggtttattttttagtttgaggtaggagtatgtgtttggtagggaagggaggtaggggttggggttgtagtttatagttttttgtttatttggagagatttgaatttttttatttttttgttgtgtggtttttattttgggttttttttttgttttttgttttttttgttatgtttgttttttgttttagtgttgtgtgaaatttttggaggaatttgtttttttgttttttttttgtatttttgatttttttttgggttgttgtgaggtggagttggtttggtttttatattttgtatttttttttttttgtaggttgttgtgtggttttgtgtatgttgttggtagattagggttagagttggaaggaggaggtggtgattgtggagatgtggtaggagggtttatttaaagttttttgtgtaagtgattatgtttgggtaaggggagggggtgttgggttttagggggttgtgattaggatt

SEQ ID NO: 291 - DNA, 2501 bp, Artificial Sequence
  chemically treated genomic DNA (Homo sapiens)
gattttagttatagttttttaaggtttagtattttttttttttgtttgggtatggttatttatgtaggaggttttgagtgagtttttttgttatgtttttatggttattattttttttttttagttttggttttgatttgttagtagtatgtgtagggttgtgtagtggtttgtggggagggagaagtatgagatgtggggattgggttgattttgttttgtagtaatttggggaggggttaggagtgtagggagggaatagggaaataggtttttttgaagattttatataatattggggtggggagtaggtatggtgggagaggtggggaataggaaggaggtttggggtaaaagttatatgatggagggataagggggtttggatttttttgggtgggtgaggggttgtgggttgtagttttagtttttgttttttttttttgttagatatatgtttttattttgaattgggaaatagattatggtgtagggtggtattgtagtgaataaagaaaagtttgttggagtttgggggaggatgttaaggtgtggtgagtgtagtttgttttttttttttgtttttggggttttatttttttttgaggtgttttgggttttttgaaagttgttaatggtattggggatgttttgggttttttaggtttttgttttgggttttgaggtgggtgaggagttttgttgggagtttgggtttgatgttgtgggttggttttatgttgggagttttgagttttatttttggggatgtgggttgtgtgtatttattggtggtgaagattgtggtggtgaaattttagtgaaggttttgtggtttttgagttttataagggtggttttgttttgttttgttttagtgttgagttatggtgttggttgtttttttggagggttttgtggatttttgttggttttagttttggtggttgttgtattttgggtgttggttgtagaggggtgttttggagtttttggagttgttgtgtagttggttggggaagttttttttttttttttaggtttttagtggggtttagggagtaaatagatagtaggaagaggattgtagtgaagtgtgtgtagtgaattggtgtgttgggatattgtggggggaaattttttaagattgttgtgattttggagtttgtatatttgttttatagggtaggggagaggggtggaggttgtttagaggaaaggaaattgttttattttattttattttattttatttttttattttattttattttattttattttattttattttattttattttattttattttgtgttattttattttattttatgatgtagttttatgttgtggtttaggttggagtgtagtggtgtgattttggtggtttattgtaatttttgttttttgggtttaagtaattttgttttagttttttgagtaggtggaattataggtgtgtgttatatttggttgatttttgtatttttagtagagatggggttttattatgttggttgggttggttttgaatttttgattttaggtgatttgtatgttttggttttttaaagtgttgggattataggtgtgagttattatgtttggttgtttaatttttatttgaagttttggggtatatgtagaggatgtgtaggtttgttatataggtgtgtgtgttatgatggtttgttgtatagattattttattatttaggtattaagtttagtattttttagttattttttttggtattttttttttttagtattttgtttaataggtattagtgtgtgttgattgttgttatgtgattatgtgtttttattgtttagtttttatttataagtgagattatgtggttttgttggttttttgtttttgtgtgagtttgttgaggttaatggtttttagttttatttatgtttttgtaaaggatatgattatgttttttttagtggttgtgttttaggttattttttttggttttgttgtttattttttgttgatttgtagatttttatttattttagatattgattttttgttggttttagatatgatagatagttttttttattttattaattgttaagtttgtttaaggagttttttatgaaataaaatttgttaatttaagtgtaattaaatttagtaagggatttttgtggtggggaagaggttggtgtttatgttgtatttttaaaattttatttaatgtagttattaaaaagaattagattatgttttttgtgggaatatggatggagttagaggttattatttttagtaaattaatgtaggaatagaaatttaaatattggatgtttttatttgtaagtgggagttaaatgatgagaatttataatataaataaggaaataatagatattgtggttgattttagggtgtaggatgggaggaaggagaggagtagaaaagagaattattgggtatttggtataatatttgggtgatgaaatattttgtataataa

SEQ ID NO: 292 - DNA, 2501 bp, Artificial Sequence
  chemically treated genomic DNA (Homo sapiens)
ttagagtttgaagttttgtattaggtgtgtggtgttttaggagtaggagttttatggtttttaatagaaattttgatgtttagggagatttttgtgagtgtttttgatgtttagggggtatttttggtttattttttgaaggaggtgtgtgatgggaaaggtagttggtgtggatgttttgggatattgtatgtgtttagaaatgtggtgggaaggttaaagttttagagtaagtggttgggttgttgatttaggagtgtgtttttttggtttgaggttgggtgtttttattggttattttaggggtttgattaggtttgaggaagttttttttagttatttattgaagtagaagttgtggtttttatagatgaattggagggtgtttattagttttttgttgtatagggttttattggggtggtaagtagtaatgtagtatgaggtgaaggttaagaaggtgagaagtattagtattgatttttttattgggatttttattggtgtttgggggtgggagagaagtggtgtgagtggggtagttaggttaagttttaggttagaggtgttttttttaaattaaatttgttaatttataaatttagttgaaaattgaaagtatggtttttttataaatattatttttattataaaagtaatatataggttataatgttgaggtgagggtgtagggttatgtgtagaatgaagtgtttagaagtatatagaaaaggtttagttttttttatttgtaagaagtattagtaattttatatgaggggtgattatttttatggttattattgtaggagtttagtggtatttatagttgtaggggtttaggttggatatttgatttggtttttgttttatgatattatgggggtagggttagtttagtgttatattgttattttttaggtttttagtgttagttaagatggtagatagttttatttttatagagtatgtgtatttaggaggattagtttttttttttttataatttttagttgagtagggggggtttaggaggattattgtttttaaagtagtaggttagttttgttgggttagttttgtttttttttttggtttttttatttttttagtttgtagttgagttaggtttgggttaaggattttaatggttaatataattatgttatttatgttttagaaattttgtttttttagttatttagttttttaattttagtttgttttgggtatttttaaatatatatatatatgtttagagttttttttttaggttttaaattgaattagtaaggttaggggtttttagaatatttttttatttgtgttattaaattttttttgtgggagttggagagattagtttaggttatttgggaagtttgatattaggttttttagattataatttggaaggggaggttagttttaggatatattttttttataggttgtagggttatagggttgggttaatttatttgggggtgggaggttgggagttattatagtaagttggttttgtttttgtagaaggtggaattttttaggtgggtagttttagtttttgttttgtagatttaggggagtttttgatgtaataaattatgtgagtgattgagtaggtagtgggatagaagtataattttgtatgttttttttaaagattagtgggtagttgtgttgaggatttgaaagtttttttggttatttttttgattggattttggttagtttttttattgttttttttgttatttttttttaaattttaagagtatattttgttagttggttattttagtttttgttgtgtttttgtaataagttttattattttgaatttggaggtttgggttaggggattggtagaaagtaggataggaagtatgtagtggtgtggagtaggtgagggtttaggaaaagttttgagttgggtaaggagggggttgaagggaaggaatagaaagggaaggagtaggtgagggagtagagattaggtgggggtaggggtagaggaaaagaggggaggggggtgttgtttgagaggtagtgggttggtggttgtagggtttgaggtttaggtgtgggttgtgttttttgttgttttgttttaggttggagtgggatggtagtgggggtttttattttatagttttggttatttatagtttagtagaaggtttgttggggtaggaggaggaggaggaagaggaggaggaggaagttggaagttttttttataggagaagttaatgtttagtttgtaggttggttagtgttttagtttttatgtgtgagttgattttttttagtttgggttttattttattttttatttttttttttgttgattatttttttgtgtttttgtttttgttttttttttttttttagttagtttttttttttttgtatttttaattgggagttttggattattttgtagtgaagtgttatgggtttttattttgtatttttggtttatttttgtatagggt

SEQ ID NO: 293 - DNA, 2501 bp, Artificial Sequence
  chemically treated genomic DNA (Homo sapiens)
gttttgtgtagagatgagttgggggtgtaggatgggagtttatggtattttgttatgggatggtttagggtttttggttgggggtgtaggagagaagagattggttgggaggagggagagggtgggagtaaaggtgtgggggagtggttagtagggagaggggtggggggtagggtggagtttgggttgggaggagttggtttatatataaaagttgaggtattgattagtttgtaaattggatattagttttttttgtgaaagagatttttagtttttttttttttttttttttttttttttttttgttttagtgagttttttgttgagttgtaggtaattagggttgtggagtgaggatttttgttgttattttattttagtttgaggtagggtagtagggggtatggtttatgtttgggttttgggttttgtagttgttagtttgttgttttttggatagtattttttttttttttttttttttgtttttgtttttatttggtttttgtttttttatttgttttttttttttttgttttttttttttggttttttttttgtttagtttaggattttttttgggtttttatttgttttgtattgttgtatgttttttgttttgttttttgttggttttttgatttggatttttaagtttagagtggtggggtttgttgtggaagtgtggtgagggttagagtggttagttggtggagtgtgtttttagaatttggaagggggtggtagagggggtggtgagaggattggttagggtttagttaaggagatgattaaggaggtttttagatttttggtgtagttgtttattagtttttagagagggtatgtaaagttgtgtttttgttttattgtttgtttagttgtttatataatttattgtattaaaaatttttttgggtttgtggagtgaaggttggggttgtttgtttggagggttttattttttgtaggggtagggttaatttgttgtggtggtttttggttttttatttttgagtgggttaatttggttttgtggttttgtagtttgtggagggggtgtgttttaagattggtttttttttttagattgtagtttggggaatttggtgttggattttttaggtggtttgagttggtttttttagtttttatggggagagtttggtagtgtaaatagggagatgttttggaggtttttggttttattggtttgatttgaggtttggaaaggaggttttgggtgtgtgtgtgtgtgtttgggggtatttaaggtagattggagttggagaattgggtgattgggaaaataaggtttttagagtatgggtggtgtggttgtgttaattattggagtttttgatttaggtttggtttagttgtagattggaaaggtggaaaagttagggggaggggtggggttggtttagtaggattggtttgttgttttgagggtgatggtttttttggattttttttgtttagttgggggttgtggggaggaagggattggtttttttggatgtatatgttttgtaggggtggggttgtttgttattttggttggtgttggaggtttgagaagtggtgatgtgatgttgggttggttttgtttttatggtgttataggatggaggttaggttgggtgtttagtttgggtttttgtagttgtggatgttgttgagtttttgtaataatgattgtggagatggttattttttgtgtaaaattattagtgttttttgtaaatggaaggaattgggttttttttgtgtgtttttggatgttttattttgtatatggttttgtgtttttattttggtattatgatttgtgtgttatttttgtaataaaaataatgtttataggaaagttgtgtttttaatttttaattgaatttgtaggttggtaaatttggtttgggaggggtatttttggtttggggtttggtttggttgttttgtttatgttattttttttttgtttttagatattaatgggaattttaatggggaagttgatgttggtgttttttatttttttggtttttgttttgtgttgtattgttgtttattgttttagtgagattttgtgtggtggggagttggtggatattttttagtttgtttgtggggattgtggtttttattttagtaagtagttgggaggggtttttttagatttggttaggtttttagagtgattggtgaggatgtttaattttaagttaggggagtatatttttaggttagtagtttagttgtttgttttgagattttgatttttttgttgtgtttttgagtatgtgtggtgttttagggtatttatattagttgttttttttattatatgttttttttgaagggtgggttagaggtgttttttagatgttaggggtatttataggggtttttttgggtattagaatttttgttgggggttgtgaggtttttgtttttgaggtattgtatgtttagtgtagggttttaggttttgg

SEQ ID NO: 294 - DNA, 6009 bp, Artificial Sequence
  chemically treated genomic DNA (Homo sapiens)
atatagtattggtttttgtttttgggttttttttttatttgtgtttatatatttgtattttaattaatataaatagtttaagtttttatagtttggaggtggttgttggagtagggttttagtgtattgtgagtttttgttttttttgttttgtagtgttgtgagttttttttttttttgtgtttggttttgtttgtgttttttttggtgtgggtatttgtagatttgttaggaggttgatgagaggtgtttttatagagttttgtttttttttagatttttaaatgaaaagaaagagaaaagttaattttttgtttttattttgtatgtatttggagagtggttggtggtgagtgatttgtataattgttttttttgtggtgtttttggatgggtggagagaatttgggtgattgagtttgaggttgagtttttttgggagtgatttatgttagttatttttatttttaagggggatttgtggttgggtttatgtgtgaaggatgggtgttagggaaattgatttatagatgatttgttttgtgagagattgataatttagttttgtgggtttttggggtgtttagattagtttttagttagaggatttggggttgtatagtttttggattttggagggggtggtttgggggtgggagattgtgagtattagtttatgttggtttttttttattttgtggtggtgaggtgggaagggttaggatgtgagtttagtattttttttagaaatgtagtattttgtttttttattttttttgtttttggtgtttttttttttatgtgtttttttttgttttttttttaagggtgttttttttttgtttttagtttatgtttgaattttttggtgttttttttttttttttttagttttttttttatgttttttgtttttgggtattttttttttttaattttttatttttgtattgtttgattttgaggggtgggagtgtattgggttgtgtatgggtgggggtgttgtgttagttttgtgtagttgttttgatgttgttgttgttgttgttgttgttgttgttttttgtagtttagtttgtgttttgtggtagttttgtagtgtattagttattattgttgttgttgttgttttgttagatttgttgttagtttgtttggtttagttttgagagagttttgaatgttagttgtgagggttatgagttagagagttttggggtgttgtgtggagagtaagtggagatagtgattttgtgttttttagtttttgtttttttgtattgtgttttttgtatttttgggtttttttgttttttttgttgtttttattgttgttatggttattttgttttgtagtaagttgtttaatgtggttatgtttgtgtttaataagttttaggttaagatgagtggtatgtttgttaggatgggtttttaggtggttatggatgaggaggtggtgggttttgtgtattgtgatgattttgattttgagtattgttagggtttgtagatggatattttgaaagttgagggagagttttgtggggatgagggtgttgaagtgtttgttgagggagatatttattattagtgaggtagtggagtttttttgttgttttttggttttaaggattaggtgggaggtggtggtgaatttgggggttatgataagtttaaaattatggtgtgggaggtaggttggaatgtgattaatgttatttaggtaagtgtgggatttttagttttgtttgttttttttttttttagtttagtgtgttgggttttgtttttgatagttgtttggtgattttggtttggagatttttttttgtatttaggaatttttttttttttattttttttagttttgtgtggggatttatgtttttaggtggtgttttttgttttaatttatgtttttttttaatggtattagttgtaagattgttaggttgaagtttggtttgagatatttgtttggagatattgtaaaagtgaaggaaatggggggagggagtaggaagtgatgagaaagaaagaaaattaggattggagggtatggtttggttttggattttggaatggatttatagttgtatttttgggaggaaagaagaaggggaaattgttgaggttggagttttttttttttgtatatatgtatagatatgtatatgtatataggtaggtatattatatgtttatagtttttttttttatgaataaaggtgtaggtataggtgtatatgatatgtatttatatatagattatagtattatttttaaatgtatttgtgtatatttttatagttttataaataaaagtatatatttgtatatattaaatatatgaatatttgtttgaatatatgtatatatatatgtatagatgtatgtagataggaattagtttgtttttttgggtgtggttttgttggagatatataggtatatatatatgaaagtatatatatgtttttatataaatatatttagtttgtaataatttagtattatttgtgtatagatttgttttttttgtttgaaattttggttgtattgtaaagaggtggttagtttttttttgtgtgattttggtgaagttttttttagaggttaagaatggtttttgttttttaggttttttttttttatttttaattttttattttttattaggtggtgtaggatttttatatagggagtaggtttggagttttggtaatgatttttgagttagtaggggttggtaggttgtagttttttgggttgaaggagattttagttttaggtaattttggttttttatagtttggttttgtggtgtttttggagtgtattattattggggttatggaaggtaggttttttgggagtagaggttttttaggggttgttttatgtattggggtaagtaggattttattgggttttgaatattagatggtttgatttaaggtgttttttgttttggggtttggtgagatggttttgttggattatggatttggggttgtttttgtttttgttgtgttttgtgattttttggggtgttttttaaggttttgtttgataggttttaagggaggttagggtaggaggttggaggtttgtaggtttttgggattttggattttgttagtttttagtttttgtgtggattttaaattttatagttttgtttgtttgattttgaagtttttggttttagatttttgtttggtttggttttttggtttttttggtgtttttttgttaagtttttttttttgtttgtttttttagtttttatttagtttttttttttaggttttgtttttgttttattttaattttagttttgttttaagatttttaatttttagttttgtttttttttttttgtgtgttgttttttaagtgtttttatattgtttttgtttttgttttttaggggttttgttttatttttagtttttttttttttttattttattttttttttgttttataattgtagtttttaatgtttttttttttggtttgagtttgagatgtttgagtttttttttttagtttttgtgttttattttagttttattataaattttgtgtttattttttttattggtttaggtttagtttattattttttttagagtttttttttgattatgtttttttttgtttttttttatttttttttttaattttttattttgtttttgtttttagaaattattttgaagtatttttttttttttttgtggtttttttttatttttagtttttttttattttagtttttttgttattattagttattagtgtattttttttttttagatttgtttatatatttttttttttttatttttggtttgatatttgggtttattattagtttttttatatttattttgtagtttgtttttaattttttttttttggtggtttagatttaatttttagtgtttttagtgttttttttgggttatagtgttaagttatgttttttgggttttttatttgttgttaagtttgttgagtgtttgtgtttggttgtttttttgttttatagggtatgtttgtgttgggtttattttatgttattttgtatggtggttatttggggttgttttttattatttttgttgttgttgtgtgttgttatattggtaagatttttattgtgtgtttgtatgaggagaatgaagatggtgaggtggtgtgtgtgtgggatttgtatgtggttatagttaatgtttgttgtgttttgtgttttttaatgttgggtggttgagtggtgaatgtagtgtagattattgagttggtgatgatgtgtattttgtatgtggtggtgagtggtaattttatgtataatagttttttggggttgtttgtgttgtagaagttttggtttattattgttatggttgtgttgttgttttgtgttttttttaagaattttaaggttgtgtttaagtttagtttgttgtgtattttggtttattttgttattaatattttggttatagtttattgtttattgtgggtgtgtgattgggtttgggagaaggttaagttttatattgatgttaagaagttttttatttttattggtattattgtgtttagttatatgttttagatttttttgtttttgttggagggtaatatgtagtagtttagtgagttttattgtatgatgaattggatgtatattgtagtttgtgtgtttaagggtttttttgtgtttgttgtttattttatttgggttgatgagattaaggaggttattatggataatttgtttggttttatttgtgttgtggttaatatttttttggtggttaaggtgttgttgttttattttttgttattttttgttgttgttgaggtgttggagaagttgtttttttaggaaggtagttgtgttttttttttggtttgttatagtggtgatgggtgtttgaagttttgggggttgatgttgtgttgtgtgtttgttgtttttatgttgtttatggttatttatgtgttgtattttgtgttgtttatgggttttattggtagttttatgggtgttggtttttgttttttgttgtttagttttttttatttgtgtttgttttggtgtaagttgttgtggtattaagttttttttgatgttgttatttttgttattggtggtatttgtagtgtgtttggttttgtgtatttttttgagggttttattgaagtttattgaattaatgtggaggattagggtgtaagggtgagtttttgttgtgtttttgtgtttttttttttttttttttattttgtttttattagtttagtgtgttttgttgttgtgtttgggaggttaagttttaaatatttttggtttttagtttttgattatttggggatgggggggatgggaggggatagggatttatgatttattgtgtttgtgtttttgttgtttttttttttttataatattttggttttggggggaggtggggtgtatttgtgggtagggttttttgtttttttaagtggggttttgatattttggttttagttattgagggggttgggaagggagggagagggggtgtagtttgtaggtgtggtaatttgattttgggggaatattttatatttatttagagtttggaatttatagtgtttagttatttttagtaagagtgttttttattttggagatgttttaattttgtagtgggaaaggttgattgggaaatttattttgggtgggtaattttttttaatgaagttggaaggtgagaagttgtggtggggttagtttgtttgttggtttttaggaatttaaatttttattttgtgtaatttattaggtgtggaattgttttattgtgtgtgtggtgtgtttgtggtgaataagatgaaatgtatattagaaaaaaatttatttttaatttagagtgtggtatataattatatttgtaaataaagaagagataaaggtttgtgtggtttggtgttgggtttgtg

SEQ ID NO: 295 - DNA, 6009 bp, Artificial Sequence
  chemically treated genomic DNA (Homo sapiens)
tataaatttgatattgggttgtgtaagtttttgttttttttttatttgtggatataattatgtattgtattttaaattagagatagatttttttttgatatatattttattttatttattatgagtatattatatgtatagtagaatagttttatatttgataaattgtataagatgagagtttagatttttgaaaattggtaggtaagttggttttgttgtggttttttgttttttggttttgttgaaggaaattgtttatttaaaatggattttttagttagttttttttgttgtagggttgaaatgtttttggaatgggaagtgtttttgttggaaatggttggatgttgtagattttgagttttggatggatgtgaaatatttttttaaggttaagttgttatgtttgtgagttgtgttttttttttttttttttttaatttttttgatgattggaattaaagtgttggggttttatttggaaggatagagaattttgtttgtaaatgtattttgtttttttttaaaattagggtgttgtggaaaagaaaggataatagaaatgtagatgtgatggattgtgaatttttgtttttttttattttttttatttttgaataattagaaattaggaattagagatgtttaaagtttggttttttaagtgtggtggtagggtgtattgggttggtgggggtggggtgaggggagaagggagagagtgtagaagtgtggtgggggtttgtttttgtgttttagttttttgtgttggtttggtaggttttgatgaggtttttgagggagtgtatgaagttggatatgttgtagatgttgttgatgatgaagatggtgatgttgaagaagatttggtgttatagtagtttgtgttagagtaggtgtaggtgaaagaggttgggtagtaagaaatagaggttggtgtttgtgaggttgttggtgaggtttatgagtagtgtgaagtgtggtatataaatggttatgagtagtgtgaagatgatgagtgtgtagtgtagtgttagtttttaggattttaggtgtttgttgttgttgtagtaggttgggaaaaaggtgtggttgtttttttggaagagtgatttttttagtattttgatagtggtaaagaatggtagaggataggataatagtgttttggttattagaaagatgttgattatggtgtggatggagttgggtaggttatttgtgatgatttttttggttttgttggtttaggtgaggtaggtgatgagtgtgaagaggtttttgagtatgtaggttgtgatgtgtgtttagtttattatgtagtggaatttgttgggttgttgtatattgttttttagtgaaggtaggaagatttgagatgtgtagttgaatatgatgatgttaatggagatggggaattttttgatgttgatgtagaatttgatttttttttaggtttagttgtgtgtttgtgatagatagtaggttatgattaggatattgatgatgaagtgggttagagtgtatagtagattgaatttggatatggttttgaggtttttaaggaaggtgtaaggtagtagtatggttgtggtgataatggattaggatttttgtgatatgggtagttttgggaagttgttgtatatgaggttgttatttattattatgtataggatgtatgttattattagtttgatgatttgtgttatgtttattatttggttgtttagtgttgggaagtgtggggtgtagtaggtgttggttatggttatgtatgagttttgtatgtgtattattttgttgtttttattttttttgtataggtatgtgatgaggattttgttggtgtagtagtatataatggtggtgaagatgatgagaaataattttaggtagttgttgtgtaggatggtgtagggtaggtttagtatgaatatgttttgtggggtggagaggtaattagatgtggatgtttagtgaatttggtaatggatgaggggtttggggggtgtggtttaatgttgtggtttgaagggggtgttaaggatattgagaattgggtttgagttgttggggaggagaggttaagagtaggttgtggggtggatgtaggggaattaatagtgagtttgggtgttgagttagagatggagagggagggatgtatggatggatttgagaaggaaaggtgtgttaatggttggtgatagtgagagggttagggtgggagagggttgagaatagggagaagttataggagggaagggagatattttgggatggtttttggggataggaatagaatgaggagttgggggaggagatgagaagggatagaagggagtgtagttggaaaggggttttaagaaaggtagtgagttgggtttgggttagtggaaagagtgggtatgggatttgtggtggggttggaatggggtatgggagttaaagaggaaaatttgggtgttttaggtttagattagaggaggaaatgttaaaggttgtagttgtgaggtgaaaaggaaatagggtagagagggagaggggttgaaggtggggtaaagtttttgggaggtaagaatagagataatgtgaagatgtttggggagtagtgtgtggggaggaggaagtagggttggaaattgagagttttaggataaggttggagttagagtgaggtgagggtgagatttaaggaaggggattaagtggaggttggggaggtaagtaggaggaggagtttggtgggaaggtgttagggaggttagaaagttgaattgagtaagagtttagaattagaagttttagggttaggtggatagggttgtagggtttagaatttatatggggattaagagttaatgaaatttagggttttggaggtttatgagtttttagttttttgttttggttttttttggggtttattaaatggagttttgaaagatgttttgggaagttgtggggtatagtgaaggtgggagtagttttgggtttgtgatttagtaaggttgttttgttgggttttggagtggaaagtgttttgggttgggttatttggtgtttggggtttggtggagttttgtttattttgatatatggaataatttttgggaggtttttgtttttagaaaatttgttttttgtggttttagtgatagtgtgttttagggatgttgtggggttaagttgtaagggattggggttgtttagagttgaagttttttttggtttagaaagttgtggtttgttagtttttgttagtttggaggttgttgttaagattttaaatttgttttttatgtaggagttttgtgttgtttggtggggagtggggggttaggaataaggggagagggtttagagagtaggggttatttttagtttttggagagggttttgttagggttatatggggaggagttggttgtttttttgtggtgtagttgggattttgggtgagaggggtgagtttgtgtataggtaatgttggattattgtggattaaatgtgtttgtgtgggagtatgtgtgtgtttttgtgtgtgtatatttgtatgtttttaatagggttgtatttaagggagtaggttggtttttgtttgtatgtatttgtgtatgtgtgtgtgtatatgtttaaatgaatatttgtgtgtttggtatgtgtaggtatatgtttttgtttgtggagttgtaggggtgtatgtaggtgtatttggggatagtattgtggtttatatatagatatatgttgtgtgtgtttgtgtttgtgtttttgtttgtgggaaggggggttgtgggtatgtggtgtgtttgtttatatatgtgtgtgtgtttatgtgtgtgtgtggggggaggagattttgattttagtgattttttttttttttttttttttaaaaatgtagttgtgaatttgttttagagtttaagattaaattgtgttttttaattttgatttttttttttttttattgttttttgttttttttttttattttttttatttttgtagtgtttttggataggtgttttagattgaattttagtttagtggttttgtagttggtgttgttgggagggagtgtgggttagggtggaaaatattgtttgggggtgtaggtttttgtgtagggttgggagggatggagaaagggagatttttgggtataggagggggtttttaggttgagattattgggtgattgttgggggtagagtttggtatgttgagttgggaggggggaggataggtagaattgggaattttgtgtttatttggatggtgttggttatgttttagtttgttttttatgttgtgattttgggtttgttgtggtttttgaatttgttattattttttatttggtttttggagttggagggtggtagaggagttttgttgttttgttgataatggatgttttttttgatgggtgttttagtgtttttgtttttgtagggtttttttttggtttttaggatgtttatttgtaggttttggtggtgtttaaagttgaggttgttgtaatgtgtgaagtttattgtttttttatttgtggttgtttgaaaatttattttggtgaatatgttgtttattttggtttgggatttgttggatatggatgtggttatgttggatagtttgttgtggagtaaggtggttatggtggtggtggggatagtggaaaggatagaaggatttgaggatgtggggaatgtgatgtaagaaggtgagggttggggggtgtaaagttgttatttttgtttgttttttgtgtggtgttttggggttttttggtttatgatttttgtagttggtgtttgaggtttttttagggttggattgggtaagttggtagtaggtttggtggagtggtggtggtggtggtggtggttagtgtattgtggagttgttgtggggtgtgagttgggttgtggagggtggtggtggtggtggtggtggtagtggtgttagagtagttatgtgaagttggtgtggtgtttttatttgtgtgtagtttaatgtgtttttgttttttggaattaggtggtgtgggggtgggggattggagagaggaaatatttggaggtaggggatgtgaggaaggggttaggagaagagaaagggggtgttgagggatttagatgtgagttgggggtagaagaagggtgtttttgggaaggaggtgggagggagtgtgtgaaagagggagtgttgagggtaggggaggtgggggggtgaagtgttgtatttttaggggaggtgttaagtttgtattttggttttttttattttgttgttgtagggtgggagggggttggtgtgggttgatgtttgtagttttttatttttggattattttttttagggtttgggagttgtgtagttttagattttttggttaaggattggtttgggtgttttgaaagtttgtaggattgagttgttagttttttgtggagtgggttgtttataagttagtttttttggtatttattttttgtgtgtaaatttggttgtgagttttttttgaaggtagaagtggttggtatggattgtttttaaggaagtttagttttaggtttagttatttgggttttttttgtttgtttagggatgttgtgagggaagtgattgtgtggattgtttgttattagttgttttttaaatgtgtgtagaatggaggtgaaaggttggtttttttttttttttttgtttgggggtttggaagaaggtaggattttatgaggatattttttgttagttttttagtgggtttgtgaatgtttatgttgagaggggtgtagatggggttaggtgtggaggaaagaagggtttgtggtgttgtaaggtggaggaagtagaggtttgtggtgtgttggggttttgttttgatggttgtttttaggttgtgaaagtttgggttgtttgtgttgattggggtatgggtgtgtgagtgtgagtaagggagagatttagagataaagattgatgttgtat

SEQ ID NO: 296 - DNA, 22 bp, Artificial Sequence
  Detection primer for
tggtataggaggagaagagttg

SEQ ID NO: 297 - DNA, 19 bp, Artificial Sequence
  Detection primer for
tcaatccctaaaacccaaa

SEQ ID NO: 298 - DNA, 21 bp, Artificial Sequence
  Detection primer for
ggaagggaaggatgagagtat

SEQ ID NO: 299 - DNA, 22 bp, Artificial Sequence
  Detection primer for
acccaaactaacaatcaaaaat

SEQ ID NO: 300 - DNA, 21 bp, Artificial Sequence
  Detection primer for
ggaaggtttaaggtgagagaa

SEQ ID NO: 301 - DNA, 21 bp, Artificial Sequence
  Detection primer for
caaaataaccaatcccctaaa

SEQ ID NO: 302 - DNA, 23 bp, Artificial Sequence
  Detection primer for LIM/HOMEOBOX PROTEIN LHX9
ttatttgaattttggaggttatg

SEQ ID NO: 303 - DNA, 22 bp, Artificial Sequence
  Detection primer for LIM/HOMEOBOX PROTEIN LHX9
ccccaatataaatctaccaacc

SEQ ID NO: 304 - DNA, 24 bp, Artificial Sequence
  Detection primer for
ttaatgaagtagggtttgtattgt

SEQ ID NO: 305 - DNA, 21 bp, Artificial Sequence
  Detection primer for
cctccaaaatcttaaccaaat

SEQ ID NO: 306 - DNA, 22 bp, Artificial Sequence
  Detection primer for
tttattttaggagggaaggatt

SEQ ID NO: 307 - DNA, 21 bp, Artificial Sequence
  Detection primer for
cccaactaactcaaattccac

SEQ ID NO: 308 - DNA, 21 bp, Artificial Sequence
  Detection primer for
gtggttttggggaattagtat

SEQ ID NO: 309 - DNA, 22 bp, Artificial Sequence
  Detection primer for
ctcctacatatcccatctcatc

SEQ ID NO: 310 - DNA, 23 bp, Artificial Sequence
  Detection primer for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
aattaaggtttagggttttgttt

SEQ ID NO: 311 - DNA, 23 bp, Artificial Sequence
  Detection primer for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
accttccctacaaatctacctac

SEQ ID NO: 312 - DNA, 22 bp, Artificial Sequence
  Detection primer for BASSOON; ZINC FINGER PROTEIN 231; NEURONAL DOUBLE ZINC FINGER PROTEIN
atagttttgtgggtttaagagg

SEQ ID NO: 313 - DNA, 24 bp, Artificial Sequence
  Detection primer for BASSOON; ZINC FINGER PROTEIN 231; NEURONAL DOUBLE ZINC FINGER PROTEIN
accctaaccttatacaataccaac

SEQ ID NO: 314 - DNA, 22 bp, Artificial Sequence
  Detection primer for BASSOON; ZINC FINGER PROTEIN 231; NEURONAL DOUBLE ZINC FINGER PROTEIN
ggtggggttattaaggagttta

SEQ ID NO: 315 - DNA, 21 bp, Artificial Sequence
  Detection primer for BASSOON; ZINC FINGER PROTEIN 231; NEURONAL DOUBLE ZINC FINGER PROTEIN
ctcaactaccatacccaaaaa

SEQ ID NO: 316 - DNA, 20 bp, Artificial Sequence
  Detection primer for
ttgtgttggttgtaaaagga

SEQ ID NO: 317 - DNA, 23 bp, Artificial Sequence
  Detection primer for
caaacactatacacctctcaaca

SEQ ID NO: 318 - DNA, 25 bp, Artificial Sequence
  Detection primer for
ttgaggttattggtttatagatttt

SEQ ID NO: 319 - DNA, 18 bp, Artificial Sequence
  Detection primer for
ccctaaccaccccttcta

SEQ ID NO: 320 - DNA, 25 bp, Artificial Sequence
  Detection primer for
tgtgtgaaatgttttagtttaattg

SEQ ID NO: 321 - DNA, 22 bp, Artificial Sequence
  Detection primer for
actccatacacttttaccaacc

SEQ ID NO: 322 - DNA, 21 bp, Artificial Sequence
  Detection primer for HOOK2 PROTEIN
tgtgttaggaatgattgggta

SEQ ID NO: 323 - DNA, 21 bp, Artificial Sequence
  Detection primer for HOOK2 PROTEIN
aatttcaaaaccaaaatcacc

SEQ ID NO: 324 - DNA, 20 bp, Artificial Sequence
  Detection primer for
ggttgggattttagtgtgtg

SEQ ID NO: 325 - DNA, 23 bp, Artificial Sequence
  Detection primer for
aattaccaaaccaattcctctta

SEQ ID NO: 326 - DNA, 22 bp, Artificial Sequence
  Detection primer for
ttatttgagggatttattggag

SEQ ID NO: 327 - DNA, 24 bp, Artificial Sequence
  Detection primer for
ccttattaaaacttaccaccctat

SEQ ID NO: 328 - DNA, 20 bp, Artificial Sequence
  Detection primer for
gtgggttagtgggaggttat

SEQ ID NO: 329 - DNA, 22 bp, Artificial Sequence
  Detection primer for
taaaaacccttcctacctctta

SEQ ID NO: 330 - DNA, 22 bp, Artificial Sequence
  Detection primer for
agatgggtatgtattttgggtt

SEQ ID NO: 331 - DNA, 23 bp, Artificial Sequence
  Detection primer for
actaaactcaaccacctcactaa

SEQ ID NO: 332 - DNA, 22 bp, Artificial Sequence
  Detection primer for
ttttggttagttttatggggta

SEQ ID NO: 333 - DNA, 22 bp, Artificial Sequence
  Detection primer for
cactacttcaaatccatcatca

SEQ ID NO: 334 - DNA, 22 bp, Artificial Sequence
  Detection primer for LYSOSOMAL-ASSOCIATED MULTITRANSMEMBRANE PROTEIN (RETINOIC ACID- INDUCIBLE E3 PROTEIN) (HA1520) LAM5
aagagtgaggagtaagggagtt

SEQ ID NO: 335 - DNA, 22 bp, Artificial Sequence
  Detection primer for LYSOSOMAL-ASSOCIATED MULTITRANSMEMBRANE PROTEIN (RETINOIC ACID- INDUCIBLE E3 PROTEIN) (HA1520) LAM5
taacttcacaaattacccaaca

SEQ ID NO: 336 - DNA, 22 bp, Artificial Sequence
  Detection primer for "TYPE I INOSITOL-1,4,5-TRISPHOSPHATE 5-PHOSPHATASE (EC 3.1.3.56) (5PTASE)
ttttggggttagtatgtgagtt

SEQ ID NO: 337 - DNA, 20 bp, Artificial Sequence
  Detection primer for "TYPE I INOSITOL-1,4,5-TRISPHOSPHATE 5-PHOSPHATASE (EC 3.1.3.56) (5PTASE)
atcccaacaacttcttcctc

SEQ ID NO: 338 - DNA, 21 bp, Artificial Sequence
  Detection primer for PROSTAGLANDIN E2 RECEPTOR, EP4 SUBTYPE (PROSTANOID EP4 RECEPTOR) (PGE RECEPTOR, EP4 SUBTYPE)
gaagaggaatgggaaaattag

SEQ ID NO: 339 - DNA, 19 bp, Artificial Sequence
  Detection primer for PROSTAGLANDIN E2 RECEPTOR, EP4 SUBTYPE (PROSTANOID EP4 RECEPTOR) (PGE RECEPTOR, EP4 SUBTYPE)
tcaccaacaaaatacccaa

SEQ ID NO: 340 - DNA, 24 bp, Artificial Sequence
  Detection primer for PROSTAGLANDIN E2 RECEPTOR, EP4 SUBTYPE (PROSTANOID EP4 RECEPTOR) (PGE RECEPTOR, EP4 SUBTYPE)
tgagtaagatgattatttggattt

SEQ ID NO: 341 - DNA, 22 bp, Artificial Sequence
  Detection primer for PROSTAGLANDIN E2 RECEPTOR, EP4 SUBTYPE (PROSTANOID EP4 RECEPTOR) (PGE RECEPTOR, EP4 SUBTYPE)
aaccatcaaccatacctatttc

SEQ ID NO: 342 - DNA, 22 bp, Artificial Sequence
  Detection primer for
attgggtttgaaagagttgtag

SEQ ID NO: 343 - DNA, 21 bp, Artificial Sequence
  Detection primer for
cacttcccacctccttatatc

SEQ ID NO: 344 - DNA, 23 bp, Artificial Sequence
  Detection primer for
atgatgggaatatgtaagaatga

SEQ ID NO: 345 - DNA, 24 bp, Artificial Sequence
  Detection primer for
cttctcactactaatctcctaccc

SEQ ID NO: 346 - DNA, 21 bp, Artificial Sequence
  Detection primer for EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE
gagttggagggttttgtttta

SEQ ID NO: 347 - DNA, 22 bp, Artificial Sequence
  Detection primer for EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE
caaactcccataaaattcatct

SEQ ID NO: 348 - DNA, 21 bp, Artificial Sequence
  Detection primer for ORPHAN NUCLEAR RECEPTOR NR5A2 (ALPHA-1-FETOPROTEIN TRANSCRIPTION FACTOR) (HEPATOCYTIC TRANSCRIPTIONFACTOR) (B1-BINDING FACTOR) (HB1F) (CYP7A PROMOTER BINDING FACTOR)
gtgtgaggtttgggtattttt

SEQ ID NO: 349 - DNA, 19 bp, Artificial Sequence
  Detection primer for ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR)
ccactcactcaacccataa

SEQ ID NO: 350 - DNA, 22 bp, Artificial Sequence
  Detection primer for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
gatggtgggtagtgttgtttat

SEQ ID NO: 351 - DNA, 24 bp, Artificial Sequence
  Detection primer for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
aaaacctatctacacctttctctt

SEQ ID NO: 352 - DNA, 23 bp, Artificial Sequence
  Detection primer for
aattagagaaggttaaatgggtt

SEQ ID NO: 353 - DNA, 20 bp, Artificial Sequence
  Detection primer for
attcccaccaaaacctctac

SEQ ID NO: 354 - DNA, 20 bp, Artificial Sequence
  Detection primer for
gggatttgggaatttattgt

SEQ ID NO: 355 - DNA, 21 bp, Artificial Sequence
  Detection primer for
aataactccaactttcctccc

SEQ ID NO: 356 - DNA, 23 bp, Artificial Sequence
  Detection primer for
ggtggatgagtagtttgaagttt

SEQ ID NO: 357 - DNA, 18 bp, Artificial Sequence
  Detection primer for
aaaaacccctttccctct

SEQ ID NO: 358 - DNA, 22 bp, Artificial Sequence
  Detection primer for
gttggggtttagtaattgaaaa

SEQ ID NO: 359 - DNA, 24 bp, Artificial Sequence
  Detection primer for
accaacacaaactaacacttacat

SEQ ID NO: 360 - DNA, 22 bp, Artificial Sequence
  Detection primer for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
aagaggttttatggtgtttgag

SEQ ID NO: 361 - DNA, 21 bp, Artificial Sequence
  Detection primer for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
cactcccttcccaaactatac

SEQ ID NO: 362 - DNA, 22 bp, Artificial Sequence
  Detection primer for HOMEOBOX PROTEIN HOX-B6 (HOX-2B) (HOX-2.2)
gtggaaaaaggagagtaaattg

SEQ ID NO: 363 - DNA, 20 bp, Artificial Sequence
  Detection primer for HOMEOBOX PROTEIN HOX-B6 (HOX-2B) (HOX-2.2)
ctcctcaattctcaccaaaa

SEQ ID NO: 364 - DNA, 20 bp, Artificial Sequence
  Detection primer for LIM DOMAIN KINASE 1 (EC 2.7.1.37) (LIMK-1)
agggaggtttggtgtatttt

SEQ ID NO: 365 - DNA, 22 bp, Artificial Sequence
  Detection primer for LIM DOMAIN KINASE 1 (EC 2.7.1.37) (LIMK-1)
aaaccctacttcctacaaacaa

SEQ ID NO: 366 - DNA, 21 bp, Artificial Sequence
  Detection primer for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
ggaaaggataggatgttggat

SEQ ID NO: 367 - DNA, 20 bp, Artificial Sequence
  Detection primer for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
caatccccttaaaacaaacc

SEQ ID NO: 368 - DNA, 22 bp, Artificial Sequence
  Detection primer for 1-ACYL-SN-GLYCEROL-3-PHOSPHATE ACYLTRANSFERASE GAMMA (EC 2.3.1.51) (1- AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O- ACYLTRANSFERASE 3)
ttagggagatgagattaaagga

SEQ ID NO: 369 - DNA, 19 bp, Artificial Sequence
  Detection primer for 1-ACYL-SN-GLYCEROL-3-PHOSPHATE ACYLTRANSFERASE GAMMA (EC 2.3.1.51) (1- AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O- ACYLTRANSFERASE 3)
cacaatttcccacaaaaca

SEQ ID NO: 370 - DNA, 21 bp, Artificial Sequence
  Detection primer for HOMEOBOX PROTEIN GSH-2
tatatggggtgggagtatttt

SEQ ID NO: 371 - DNA, 21 bp, Artificial Sequence
  Detection primer for HOMEOBOX PROTEIN GSH-2
ccttcccctccttcttatact

SEQ ID NO: 372 - DNA, 23 bp, Artificial Sequence
  Detection primer for
ttaggggttattaggttaaatga

SEQ ID NO: 373 - DNA, 23 bp, Artificial Sequence
  Detection primer for
aaaattctttcctctcctaaaca

SEQ ID NO: 374 - DNA, 20 bp, Artificial Sequence
  Detection primer for HISTONE H4
ttagttgagaaagtgggggt

SEQ ID NO: 375 - DNA, 21 bp, Artificial Sequence
  Detection primer for HISTONE H4
ctacctcaaaccaaaatcctc

SEQ ID NO: 376 - DNA, 22 bp, Artificial Sequence
  Detection primer for POTASSIUM VOLTAGE-GATED CHANNEL SUBFAMILY KQT MEMBER 2 (NEUROBLASTOMA- SPECIFIC POTASSIUM CHANNEL KQT-LIKE 2)
ttttggagttatagggttttgt

SEQ ID NO: 377 - DNA, 19 bp, Artificial Sequence
  Detection primer for POTASSIUM VOLTAGE-GATED CHANNEL SUBFAMILY KQT MEMBER 2 (NEUROBLASTOMA- SPECIFIC POTASSIUM CHANNEL KQT-LIKE 2)
cttcaacatctcccaatcc

SEQ ID NO: 378 - DNA, 21 bp, Artificial Sequence
  Synthetic construct
gggttatgttaagggagaaag

SEQ ID NO: 379 - DNA, 22 bp, Artificial Sequence
  Synthetic construct
aaacctaaaaatccaacacaaa

SEQ ID NO: 380 - DNA, 27 bp, Artificial Sequence
  Detection primer for
atttgtggtagttaataggtatgttta

SEQ ID NO: 381 - DNA, 21 bp, Artificial Sequence
  Detection primer for
aataacctaatctccaaaccc

SEQ ID NO: 382 - DNA, 22 bp, Artificial Sequence
  Detection primer for
tagagaagttgtttgttggttg

SEQ ID NO: 383 - DNA, 24 bp, Artificial Sequence
  Detection primer for
tacccaccatataccaaaactaaa

SEQ ID NO: 384 - DNA, 22 bp, Artificial Sequence
  Detection primer for PERIPLAKIN (195 KDA CORNIFIED ENVELOPE PRECURSOR) (190 KDA PARANEOPLASTIC PEMPHIGUS ANTIGEN)
atttgaggggtattatttgttg

SEQ ID NO: 385 - DNA, 19 bp, Artificial Sequence
  Detection primer for PERIPLAKIN (195 KDA CORNIFIED ENVELOPE PRECURSOR) (190 KDA PARANEOPLASTIC PEMPHIGUS ANTIGEN)
aaccaccttctcccctaat

SEQ ID NO: 386 - DNA, 22 bp, Artificial Sequence
  Detection primer for
gtaataattgggttaggggtta

SEQ ID NO: 387 - DNA, 25 bp, Artificial Sequence
  Detection primer for
aaccaatatcaaataactaaaatcc

SEQ ID NO: 388 - DNA, 22 bp, Artificial Sequence
  Detection primer for
tatttgagaaagtggtaggagg

SEQ ID NO: 389 - DNA, 22 bp, Artificial Sequence
  Detection primer for
aaaatccaatcctaaaacccta

SEQ ID NO: 390 - DNA, 21 bp, Artificial Sequence
  Detection primer for
tttatgtttgttgggggtagt

SEQ ID NO: 391 - DNA, 23 bp, Artificial Sequence
  Detection primer for
aaccctaacttctaaacaattcc

SEQ ID NO: 392 - DNA, 20 bp, Artificial Sequence
  Detection primer for
gtgagagtgggtgttgaaat

SEQ ID NO: 393 - DNA, 23 bp, Artificial Sequence
  Detection primer for
accccaatcaactacataactaa

SEQ ID NO: 394 - DNA, 23 bp, Artificial Sequence
  Detection primer for
gaaggtaggttagtaagaagggt

SEQ ID NO: 395 - DNA, 19 bp, Artificial Sequence
  Detection primer for
tacctaatcccccaaaaca

SEQ ID NO: 396 - DNA, 21 bp, Artificial Sequence
  Detection primer for
ggaggagttgggagttagtat

SEQ ID NO: 397 - DNA, 22 bp, Artificial Sequence
  Detection primer for
cactcacttaatcatcaccatc

SEQ ID NO: 398 - DNA, 24 bp, Artificial Sequence
  Detection primer for
tgatttgattagtttggtattgtt

SEQ ID NO: 399 - DNA, 18 bp, Artificial Sequence
  Detection primer for
caaacaccccttaaccct

SEQ ID NO: 400 - DNA, 22 bp, Artificial Sequence
  Detection primer for
tagtgtgtttggttagagtggt

SEQ ID NO: 401 - DNA, 20 bp, Artificial Sequence
  Detection primer for
acacatcttaaacttcccca

SEQ ID NO: 402 - DNA, 22 bp, Artificial Sequence
  Detection primer for DNA REPLICATION FACTOR; DOUBLE PARKED, DROSOPHILA, HOMOLOG OF
gttgggtttattttgagttgag

SEQ ID NO: 403 - DNA, 21 bp, Artificial Sequence
  Detection primer for DNA REPLICATION FACTOR; DOUBLE PARKED, DROSOPHILA, HOMOLOG OF
aaccaacacctcctaaacaat

SEQ ID NO: 404 - DNA, 22 bp, Artificial Sequence
  Detection primer for PR-DOMAIN ZINC FINGER PROTEIN 16 (TRANSCRIPTION FACTOR MEL1)
ttgtttgttttgagtaagaagg

SEQ ID NO: 405 - DNA, 22 bp, Artificial Sequence
  Detection primer for PR-DOMAIN ZINC FINGER PROTEIN 16 (TRANSCRIPTION FACTOR MEL1)
ataccccaataaccacctctat

SEQ ID NO: 406 - DNA, 22 bp, Artificial Sequence
  Synthetic construct
ggtattaggaggtagaagtgga

SEQ ID NO: 407 - DNA, 21 bp, Artificial Sequence
  Synthetic construct
accaatctaaaaatccccaac

SEQ ID NO: 408 - DNA, 19 bp, Artificial Sequence
  Detection primer for CDH1
gaggttggggttagaggat

SEQ ID NO: 409 - DNA, 25 bp, Artificial Sequence
  Detection primer for CDH1
caaactcacaaatactttacaattc

SEQ ID NO: 410 - DNA, 21 bp, Artificial Sequence
  Detection primer for CD44
gaaaggagaggttaaaggttg

SEQ ID NO: 411 - DNA, 21 bp, Artificial Sequence
  Detection primer for CD44
aactcacttaactccaatccc

SEQ ID NO: 412 - DNA, 21 bp, Artificial Sequence
  Detection primer for GSTP1
gttggttttatgttgggagtt

SEQ ID NO: 413 - DNA, 20 bp, Artificial Sequence
  Detection primer for GSTP1
cctctcccctaccctataaa

SEQ ID NO: 414 - DNA, 25 bp, Artificial Sequence
  Detection primer for VIAAT
gaagttgttgtatatgaggttgtta

SEQ ID NO: 415 - DNA, 21 bp, Artificial Sequence
  Detection primer for VIAAT
caaacccaattctcaatatcc

SEQ ID NO: 416 - DNA, 16 bp, Artificial Sequence
  Detection oligonucleotide for VIAAT
tagacgcggacgttta

SEQ ID NO: 417 - DNA, 18 bp, Artificial Sequence
  Detection oligonucleotide for VIAAT
taattagatgtggatgtt

SEQ ID NO: 418 - DNA, 17 bp, Artificial Sequence
  Detection oligonucleotide for VIAAT
ttcgtataggtacgcga

SEQ ID NO: 419 - DNA, 18 bp, Artificial Sequence
  Detection oligonucleotide for VIAAT
ttttgtataggtatgtga

SEQ ID NO: 420 - DNA, 16 bp, Artificial Sequence
  Detection oligonucleotide for VIAAT
ttcgtacgcgtattat

SEQ ID NO: 421 - DNA, 18 bp, Artificial Sequence
  Detection oligonucleotide for VIAAT
gagttttgtatgtgtatt

SEQ ID NO: 422 - DNA, 16 bp, Artificial Sequence
  Detection oligonucleotide for VIAAT
ttcggtcgtttagcgt

SEQ ID NO: 423 - DNA, 17 bp, Artificial Sequence
  Detection oligonucleotide for VIAAT
atttggttgtttagtgt

SEQ ID NO: 424 - DNA, 16 bp, Artificial Sequence
  Detection oligonucleotide for
gtcggtggttcgagta

SEQ ID NO: 425 - DNA, 17 bp, Artificial Sequence
  Detection oligonucleotide for
gttggtggtttgagtat

SEQ ID NO: 426 - DNA, 16 bp, Artificial Sequence
  Detection oligonucleotide for
ggaattcgacggggag

SEQ ID NO: 427 - DNA, 16 bp, Artificial Sequence
  Detection oligonucleotide for
gggaatttgatgggga

SEQ ID NO: 428 - DNA, 16 bp, Artificial Sequence
  Detection oligonucleotide for
ttcgtcgggcgtttag

SEQ ID NO: 429 - DNA, 17 bp, Artificial Sequence
  Detection oligonucleotide for
tttgttgggtgtttagt

SEQ ID NO: 430 - DNA, 16 bp, Artificial Sequence
  Detection oligonucleotide for
gtcgttcgtcgatgta

SEQ ID NO: 431 - DNA, 18 bp, Artificial Sequence
  Detection oligonucleotide for
ggttgtttgttgatgtag

SEQ ID NO: 432 - DNA, 16 bp, Artificial Sequence
  Detection oligonucleotide for
gtattgcgcgtttatt

SEQ ID NO: 433 - DNA, 17 bp, Artificial Sequence
  Detection oligonucleotide for
agggtattgtgtgttta

SEQ ID NO: 434 - DNA, 16 bp, Artificial Sequence
  Detection oligonucleotide for
aggtacgtggcgtttt

SEQ ID NO: 435 - DNA, 16 bp, Artificial Sequence
  Detection oligonucleotide for
aggtatgtggtgtttt

SEQ ID NO: 436 - DNA, 16 bp, Artificial Sequence
  Detection oligonucleotide for
gagttgcgcggtagtt

SEQ ID NO: 437 - DNA, 16 bp, Artificial Sequence
  Detection oligonucleotide for
aggagttgtgtggtag

SEQ ID NO: 438 - DNA, 16 bp, Artificial Sequence
  Detection oligonucleotide for
atagttttcgcgtttt

SEQ ID NO: 439 - DNA, 18 bp, Artificial Sequence
  Detection oligonucleotide for
agtttttgtgttttagga

SEQ ID NO: 440 - DNA, 16 bp, Artificial Sequence
  Detection oligonucleotide for
tttcggtcgcgaatat

SEQ ID NO: 441 - DNA, 18 bp, Artificial Sequence
  Detection oligonucleotide for
tttggttgtgaatatttt

SEQ ID NO: 442 - DNA, 16 bp, Artificial Sequence
  Detection oligonucleotide for
gtcgagagttcgcgtt

SEQ ID NO: 443 - DNA, 17 bp, Artificial Sequence
  Detection oligonucleotide for
tagttgagagtttgtgt

SEQ ID NO: 444 - DNA, 16 bp, Artificial Sequence
  Detection oligonucleotide for
tttcggtacgacgttt

SEQ ID NO: 445 - DNA, 17 bp, Artificial Sequence
  Detection oligonucleotide for
gagttttggtatgatgt

SEQ ID NO: 446 - DNA, 16 bp, Artificial Sequence
  Detection oligonucleotide for
attgggcgcggtttaa

SEQ ID NO: 447 - DNA, 16 bp, Artificial Sequence
  Detection oligonucleotide for
attgggtgtggtttaa

SEQ ID NO: 448 - DNA, 16 bp, Artificial Sequence
  Detection oligonucleotide for LIM/HOMEOBOX PROTEIN LHX9
attgtcgggatacgtt

SEQ ID NO: 449 - DNA, 17 bp, Artificial Sequence
  Detection oligonucleotide for LIM/HOMEOBOX PROTEIN LHX9
gattgttgggatatgtt

SEQ ID NO: 450 - DNA, 16 bp, Artificial Sequence
  Detection oligonucleotide for LIM/HOMEOBOX PROTEIN LHX9
ttagtgtcgcgttatt

SEQ ID NO: 451 - DNA, 17 bp, Artificial Sequence
  Detection oligonucleotide for LIM/HOMEOBOX PROTEIN LHX9
agtgttgtgttatttgg

SEQ ID NO: 452 - DNA, 16 bp, Artificial Sequence
  Detection oligonucleotide for LIM/HOMEOBOX PROTEIN LHX9
tgaaacgttagcgtta

SEQ ID NO: 453 - DNA, 17 bp, Artificial Sequence
  Detection oligonucleotide for LIM/HOMEOBOX PROTEIN LHX9
agtgaaatgttagtgtt

SEQ ID NO: 454 - DNA, 16 bp, Artificial Sequence
  Detection oligonucleotide for LIM/HOMEOBOX PROTEIN LHX9
aaaggcgcggttttta

SEQ ID NO: 455 - DNA, 16 bp, Artificial Sequence
  Detection oligonucleotide for LIM/HOMEOBOX PROTEIN LHX9
ttgaaaggtgtggttt

SEQ ID NO: 456 - DNA, 16 bp, Artificial Sequence
  Detection oligonucleotide for
taagtagcggcgttgt

SEQ ID NO: 457 - DNA, 17 bp, Artificial Sequence
  Detection oligonucleotide for
taagtagtggtgttgta

SEQ ID NO: 458 - DNA, 16 bp, Artificial Sequence
  Detection oligonucleotide for
gagatgagcgtcgtgg

SEQ ID NO: 459 - DNA, 16 bp, Artificial Sequence
  Detection oligonucleotide for
gagatgagtgttgtgg

SEQ ID NO: 460 - DNA, 18 bp, Artificial Sequence
  Detection oligonucleotide for
gtcgttcgttagtaacgg

SEQ ID NO: 461 - DNA, 18 bp, Artificial Sequence
  Detection oligonucleotide for
gttgtttgttagtaatgg

SEQ ID NO: 462 - DNA, 16 bp, Artificial Sequence
  Detection oligonucleotide for
tatcggttttcgcggt

SEQ ID NO: 463 - DNA, 17 bp, Artificial Sequence
  Detection oligonucleotide for
atattggtttttgtggt

SEQ ID NO: 464 - DNA, 16 bp, Artificial Sequence
  Detection oligonucleotide for
ttggacggcgtgtatt

SEQ ID NO: 465 - DNA, 16 bp, Artificial Sequence
  Detection oligonucleotide for
tttggatggtgtgtat

SEQ ID NO: 466 - DNA, 16 bp, Artificial Sequence
  Detection oligonucleotide for
gacgttgtcgtaatga

SEQ ID NO: 467 - DNA, 17 bp, Artificial Sequence
  Detection oligonucleotide for
tgatgttgttgtaatga

SEQ ID NO: 468 - DNA, 16 bp, Artificial Sequence
  Detection oligonucleotide for
agtatacgagacgcga

SEQ ID NO: 469 - DNA, 18 bp, Artificial Sequence
  Detection oligonucleotide for
agagtatatgagatgtga

SEQ ID NO: 470 - DNA, 16 bp, Artificial Sequence
  Detection oligonucleotide for
ttcgtttatcgtgcgg

SEQ ID NO: 471 - DNA, 17 bp, Artificial Sequence
  Detection oligonucleotide for
tttgtttattgtgtggt

SEQ ID NO: 472 - DNA, 16 bp, Artificial Sequence
  Detection oligonucleotide for
aggacgtagagcgtag

SEQ ID NO: 473 - DNA, 16 bp, Artificial Sequence
  Detection oligonucleotide for
tgaggatgtagagtgt

SEQ ID NO: 474 - DNA, 16 bp, Artificial Sequence
  Detection oligonucleotide for
tatagacggtgggcga

SEQ ID NO: 475 - DNA, 16 bp, Artificial Sequence
  Detection oligonucleotide for
tatagatggtgggtga

SEQ ID NO: 476 - DNA, 16 bp, Artificial Sequence
  Detection oligonucleotide for
atttatcgcggtggtt

SEQ ID NO: 477 - DNA, 16 bp, Artificial Sequence
  Detection oligonucleotide for
ggatttattgtggtgg

SEQ ID NO: 478 - DNA, 16 bp, Artificial Sequence
  Detection oligonucleotide for
attcgttgattcgcgg

SEQ ID NO: 479 - DNA, 17 bp, Artificial Sequence
  Detection oligonucleotide for
tttgttgatttgtgggg

SEQ ID NO: 480 - DNA, 16 bp, Artificial Sequence
  Detection oligonucleotide for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
tttagtcgattcggga

SEQ ID NO: 481 - DNA, 16 bp, Artificial Sequence
  Detection oligonucleotide for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
agttgatttgggagaa

SEQ ID NO: 482 - DNA, 16 bp, Artificial Sequence
  Detection oligonucleotide for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
tgagcgagttcggaga

SEQ ID NO: 483 - DNA, 16 bp, Artificial Sequence
  Detection oligonucleotide for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
gatgagtgagtttgga

SEQ ID NO: 484 - DNA, 16 bp, Artificial Sequence
  Detection oligonucleotide for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
tttcgggagtttcgta

SEQ ID NO: 485 - DNA, 17 bp, Artificial Sequence
  Detection oligonucleotide for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
tttgggagttttgtagt

SEQ ID NO: 486 - DNA, 16 bp, Artificial Sequence
  Detection oligonucleotide for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
tttcggtcgtagtcgg

SEQ ID NO: 487 - DNA, 18 bp, Artificial Sequence
  Detection oligonucleotide for UBIQUITIN-LIKE PROTEIN SMT3C PRECURSOR (UBIQUITIN-HOMOLOGY DOMAIN PROTEIN PIC1) (UBIQUITIN-LIKE PROTEIN UBL1) (UBIQUITIN-RELATED PROTEIN SUMO-1) (GAP MODIFYING PROTEIN 1) (GMP1) (SENTRIN)
atttttggttgtagttgg

SEQ ID NO: 488 - DNA, 17 bp, Artificial Sequence
  Detection oligonucleotide for BASSOON; ZINC FINGER PROTEIN 231; NEURONAL DOUBLE ZINC FINGER PROTEIN
attgagttcgggttcgt

SEQ ID NO: 489 - DNA, 17 bp, Artificial Sequence
  Detection oligonucleotide for BASSOON; ZINC FINGER PROTEIN 231; NEURONAL DOUBLE ZINC FINGER PROTEIN
attgagtttgggtttgt

SEQ ID NO: 490 - DNA, 16 bp, Artificial Sequence
  Detection oligonucleotide for BASSOON; ZINC FINGER PROTEIN 231; NEURONAL DOUBLE ZINC FINGER PROTEIN
tagcgtatatgcgatt

SEQ ID NO: 491 - DNA, 17 bp, Artificial Sequence
  Detection oligonucleotide for BASSOON; ZINC FINGER PROTEIN 231; NEURONAL DOUBLE ZINC FINGER PROTEIN
gggtagtgtatatgtga

SEQ ID NO: 492 - DNA, 20 bp, Artificial Sequence
  Detection oligonucleotide for BASSOON; ZINC FINGER PROTEIN 231; NEURONAL DOUBLE ZINC FINGER PROTEIN
atatgcgattgattttacgg

SEQ ID NO: 493 - DNA, 20 bp, Artificial Sequence
  Detection oligonucleotide for BASSOON; ZINC FINGER PROTEIN 231; NEURONAL DOUBLE ZINC FINGER PROTEIN
atatgtgattgattttatgg

SEQ ID NO: 494 - DNA, 16 bp, Artificial Sequence
  Detection oligonucleotide for BASSOON; ZINC FINGER PROTEIN 231; NEURONAL DOUBLE ZINC FINGER PROTEIN
ttatagcgtcgtatgg

SEQ ID NO: 495 - DNA, 17 bp, Artificial Sequence
  Detection oligonucleotide for BASSOON; ZINC FINGER PROTEIN 231; NEURONAL DOUBLE ZINC FINGER PROTEIN
atagtgttgtatgggaa

SEQ ID NO: 496 - DNA, 16 bp, Artificial Sequence
  Detection oligonucleotide for BASSOON; ZINC FINGER PROTEIN 231; NEURONAL DOUBLE ZINC FINGER PROTEIN
gacgtaggttcgtgat

SEQ ID NO: 497 - DNA, 17 bp, Artificial Sequence
  Detection oligonucleotide for BASSOON; ZINC FINGER PROTEIN 231; NEURONAL DOUBLE ZINC FINGER PROTEIN
atgatgtaggtttgtga

SEQ ID NO: 498 - DNA, 16 bp, Artificial Sequence
  Detection oligonucleotide for BASSOON; ZINC FINGER PROTEIN 231; NEURONAL DOUBLE ZINC FINGER PROTEIN
ggtagcgtttattcgt

SEQ ID NO: 499 - DNA, 18 bp, Artificial Sequence
  Detection oligonucleotide for BASSOON; ZINC FINGER PROTEIN 231; NEURONAL DOUBLE ZINC FINGER PROTEIN
aggtagtgtttatttgta

SEQ ID NO: 500 - DNA, 16 bp, Artificial Sequence
  Detection oligonucleotide for BASSOON; ZINC FINGER PROTEIN 231; NEURONAL DOUBLE ZINC FINGER PROTEIN
atagtcgagtttcgtt

SEQ ID NO: 501 - DNA, 17 bp, Artificial Sequence
  Detection oligonucleotide for BASSOON; ZINC FINGER PROTEIN 231; NEURONAL DOUBLE ZINC FINGER PROTEIN
gttgagttttgtttagg

SEQ ID NO: 502 - DNA, 16 bp, Artificial Sequence
  Detection oligonucleotide for BASSOON; ZINC FINGER PROTEIN 231; NEURONAL DOUBLE ZINC FINGER PROTEIN
tgggtatacgtgttag

SEQ ID NO: 503 - DNA, 18 bp, Artificial Sequence
  Detection oligonucleotide for BASSOON; ZINC FINGER PROTEIN 231; NEURONAL DOUBLE ZINC FINGER PROTEIN
tatgggtatatgtgttag

SEQ ID NO: 504 - DNA, 16 bp, Artificial Sequence
  Detection oligonucleotide for BASSOON; ZINC FINGER PROTEIN 231; NEURONAL DOUBLE ZINC FINGER PROTEIN
ttagatgcgtaaggtt

SEQ ID NO: 505 - DNA, 18 bp, Artificial Sequence
  Detection oligonucleotide for BASSOON; ZINC FINGER PROTEIN 231; NEURONAL DOUBLE ZINC FINGER PROTEIN
attagatgtgtaaggttt

SEQ ID NO: 506 - DNA, 16 bp, Artificial Sequence
  Detection oligonucleotide for BASSOON; ZINC FINGER PROTEIN 231; NEURONAL DOUBLE ZINC FINGER PROTEIN
ttatgggtcgtaggat

SEQ ID NO: 507 - DNA, 16 bp, Artificial Sequence
  Detection oligonucleotide for BASSOON; ZINC FINGER PROTEIN 231; NEURONAL DOUBLE ZINC FINGER PROTEIN
atgggttgtaggattg

SEQ ID NO: 508 - DNA, 19 bp, Artificial Sequence
  Detection oligonucleotide for
ttcgtttagttacgtacgg

SEQ ID NO: 509 - DNA, 19 bp, Artificial Sequence
  Detection oligonucleotide for
tttgtttagttatgtatgg

SEQ ID NO: 510 - DNA, 17 bp, Artificial Sequence
  Detection oligonucleotide for
tagttacgtacggatat

SEQ ID NO: 511 - DNA, 19 bp, Artificial Sequence
  Detection oligonucleotide for
ttatgtatggatattttgg

SEQ ID NO: 512 - DNA, 16 bp, Artificial Sequence
  Detection oligonucleotide for
aggatacgtagttcgt

SEQ ID NO: 513 - DNA, 19 bp, Artificial Sequence
  Detection oligonucleotide for
aggatatgtagtttgtata

SEQ ID NO: 514 - DNA, 17 bp, Artificial Sequence
  Detection oligonucleotide for
agttcgtatattttcgg

SEQ ID NO: 515 - DNA, 19 bp, Artificial Sequence
  Detection oligonucleotide for
agtttgtatatttttggta

SEQ ID NO: 516 - DNA, 16 bp, Artificial Sequence
  Detection oligonucleotide for
tacggggtcgttcgta

SEQ ID NO: 517 - DNA, 17 bp, Artificial Sequence
  Detection oligonucleotide for
tatggggttgtttgtat

SEQ ID NO: 518 - DNA, 16 bp, Artificial Sequence
  Detection oligonucleotide for
ttcgtaggcgatcgta

SEQ ID NO: 519 - DNA, 17 bp, Artificial Sequence
  Detection oligonucleotide for
gatttgtaggtgattgt

SEQ ID NO: 520 - DNA, 16 bp, Artificial Sequence
  Detection oligonucleotide for
tagcggtcgattcgtt

SEQ ID NO: 521 - DNA, 17 bp, Artificial Sequence
  Detection oligonucleotide for
tagtggttgatttgttt

SEQ ID NO: 522 - DNA, 17 bp, Artificial Sequence
  Detection oligonucleotide for
gtcgttacgtttttcgg

SEQ ID NO: 523 - DNA, 21 bp, Artificial Sequence
  Detection oligonucleotide for
tagagttgttatgttttttgg

SEQ ID NO: 524 - DNA, 16 bp, Artificial Sequence
  Detection oligonucleotide for
aagttcgttacggcgg

SEQ ID NO: 525 - DNA, 16 bp, Artificial Sequence
  Detection oligonucleotide for
agtttgttatggtggg

SEQ ID NO: 526 - DNA, 16 bp, Artificial Sequence
  Detection oligonucleotide for
tacgttggtcgacgtt

SEQ ID NO: 527 - DNA, 17 bp, Artificial Sequence
  Detection oligonucleotide for
tttatgttggttgatgt

SEQ ID NO: 528 - DNA, 16 bp, Artificial Sequence
  Detection oligonucleotide for
gagtcggacggtgttt

SEQ ID NO: 529 - DNA, 16 bp, Artificial Sequence
  Detection oligonucleotide for
gagttggatggtgttt

SEQ ID NO: 530 - DNA, 17 bp, Artificial Sequence
  Detection oligonucleotide for HOOK2 PROTEIN
tagcgtaaagggacgag

SEQ ID NO: 531 - DNA, 17 bp, Artificial Sequence
  Detection oligonucleotide for HOOK2 PROTEIN
tagtgtaaagggatgag

SEQ ID NO: 532 - DNA, 16 bp, Artificial Sequence
  Detection oligonucleotide for HOOK2 PROTEIN
atgcggatatttcgtt

SEQ ID NO: 533 - DNA, 17 bp, Artificial Sequence
  Detection oligonucleotide for HOOK2 PROTEIN
ggatgtggatattttgt

SEQ ID NO: 534 - DNA, 16 bp, Artificial Sequence
  Detection oligonucleotide for HOOK2 PROTEIN
atttcgttttcggagt

SEQ ID NO: 535 - DNA, 18 bp, Artificial Sequence
  Detection oligonucleotide for HOOK2 PROTEIN
ggatattttgtttttgga

SEQ ID NO: 536 - DNA, 16 bp, Artificial Sequence
  Detection oligonucleotide for HOOK2 PROTEIN
aggtagcgtaaaggga

SEQ ID NO: 537 - DNA, 16 bp, Artificial Sequence
  Detection oligonucleotide for HOOK2 PROTEIN
aggtagtgtaaaggga

SEQ ID NO: 538 - DNA, 16 bp, Artificial Sequence
  Detection oligonucleotide for
taacgtatcgttaggg

SEQ ID NO: 539 - DNA, 18 bp, Artificial Sequence
  Detection oligonucleotide for
aatgtattgttagggatg

SEQ ID NO: 540 - DNA, 16 bp, Artificial Sequence
  Detection oligonucleotide for
tttttggcgcggagta

SEQ ID NO: 541 - DNA, 16 bp, Artificial Sequence
  Detection oligonucleotide for
ttttggtgtggagtag

SEQ ID NO: 542 - DNA, 16 bp, Artificial Sequence
  Detection oligonucleotide for
tagagttcgacgggtt

SEQ ID NO: 543 - DNA, 16 bp, Artificial Sequence
  Detection oligonucleotide for
agagtttgatgggttt

SEQ ID NO: 544 - DNA, 18 bp, Artificial Sequence
  Detection oligonucleotide for
atcgaatttatcggtcgg

SEQ ID NO: 545 - DNA, 18 bp, Artificial Sequence
  Detection oligonucleotide for
attgaatttattggttgg

SEQ ID NO: 546 - DNA, 16 bp, Artificial Sequence
  Detection oligonucleotide for
tattacggggaacggt

SEQ ID NO: 547 - DNA, 17 bp, Artificial Sequence
  Detection oligonucleotide for
tattatggggaatggtt

SEQ ID NO: 548 - DNA, 16 bp, Artificial Sequence
  Detection oligonucleotide for
gaacggttcgttttta

SEQ ID NO: 549 - DNA, 16 bp, Artificial Sequence
  Detection oligonucleotide for
gggaatggtttgtttt

SEQ ID NO: 550 - DNA, 16 bp, Artificial Sequence
  Detection oligonucleotide for
aaggggatcgtttttt

SEQ ID NO: 551 - DNA, 17 bp, Artificial Sequence
  Detection oligonucleotide for
taaggggattgtttttt

SEQ ID NO: 552 - DNA, 16 bp, Artificial Sequence
  Detection oligonucleotide for
ttttagggcggtttaa

SEQ ID NO: 553 - DNA, 16 bp, Artificial Sequence
  Detection oligonucleotide for
ttagggtggtttaagg

SEQ ID NO: 554 - DNA, 16 bp, Artificial Sequence
  Detection oligonucleotide for
tgacgaaaatcgattg

SEQ ID NO: 555 - DNA, 18 bp, Artificial Sequence
  Detection oligonucleotide for
gatgaaaattgattggat

SEQ ID NO: 556 - DNA, 16 bp, Artificial Sequence
  Detection oligonucleotide for
gggtatacgaatacgt

SEQ ID NO: 557 - DNA, 18 bp, Artificial Sequence
  Detection oligonucleotide for
gtgggtatatgaatatgt

SEQ ID NO: 558 - DNA, 16 bp, Artificial Sequence
  Detection oligonucleotide for
ttcgaggttacgggtt

SEQ ID NO: 559 - DNA, 16 bp, Artificial Sequence
  Detection oligonucleotide for
tttgaggttatgggtt

SEQ ID NO: 560 - DNA, 18 bp, Artificial Sequence
  Detection oligonucleotide for
tgttcgaggtatatacgt

SEQ ID NO: 561 - DNA, 19 bp, Artificial Sequence
  Detection oligonucleotide for
ttgtttgaggtatatatgt

SEQ ID NO: 562 - DNA, 17 bp, Artificial Sequence
  Detection oligonucleotide for
aggagattcggttatat

SEQ ID NO: 563 - DNA, 18 bp, Artificial Sequence
  Detection oligonucleotide for
gaggagatttggttatat

SEQ ID NO: 564 - DNA, 18 bp, Artificial Sequence
  Detection oligonucleotide for
gttattttcggtaatgtt

SEQ ID NO: 565 - DNA, 18 bp, Artificial Sequence
  Detection oligonucleotide for
aggttatttttggtaatg

SEQ ID NO: 566 - DNA, 18 bp, Artificial Sequence
  Detection oligonucleotide for
tattagtcgttagtttga

SEQ ID NO: 567 - DNA, 19 bp, Artificial Sequence
  Detection oligonucleotide for
tattagttgttagtttgag

SEQ ID NO: 568 - DNA, 18 bp, Artificial Sequence
  Detection oligonucleotide for
aggtttatacgataaagg

SEQ ID NO: 569 - DNA, 19 bp, Artificial Sequence
  Detection oligonucleotide for
aggtttatatgataaaggt

SEQ ID NO: 570 - DNA, 17 bp, Artificial Sequence
  Detection oligonucleotide for
ttcgaatattagcgcgt

SEQ ID NO: 571 - DNA, 19 bp, Artificial Sequence
  Detection oligonucleotide for
attttgaatattagtgtgt

SEQ ID NO: 572 - DNA, 16 bp, Artificial Sequence
  Detection oligonucleotide for
tttatgagcggcgagt

SEQ ID NO: 573 - DNA, 16 bp, Artificial Sequence
  Detection oligonucleotide for
gagtggtgagtttagg

SEQ ID NO: 574 - DNA, 16 bp, Artificial Sequence
  Detection oligonucleotide for
agtcggtaacgcgtat

SEQ ID NO: 575 - DNA, 17 bp, Artificial Sequence
  Detection oligonucleotide for
agagttggtaatgtgta

SEQ ID NO: 576 - DNA, 16 bp, Artificial Sequence
  Detection oligonucleotide for
ttttttacgcggaagg

SEQ ID NO: 577 - DNA, 16 bp, Artificial Sequence
  Detection oligonucleotide for
ttttatgtggaagggg

SEQ ID NO: 578 - DNA, 16 bp, Artificial Sequence
  Detection oligonucleotide for LYSOSOMAL-ASSOCIATED MULTITRANSMEMBRANE PROTEIN (RETINOIC ACID- INDUCIBLE E3 PROTEIN) (HA1520) LAM5
aggtcggtcgtagata

SEQ ID NO: 579 - DNA, 16 bp, Artificial Sequence
  Detection oligonucleotide for LYSOSOMAL-ASSOCIATED MULTITRANSMEMBRANE PROTEIN (RETINOIC ACID- INDUCIBLE E3 PROTEIN) (HA1520) LAM5
gaggttggttgtagat

SEQ ID NO: 580 - DNA, 16 bp, Artificial Sequence
  Detection oligonucleotide for LYSOSOMAL-ASSOCIATED MULTITRANSMEMBRANE PROTEIN (RETINOIC ACID- INDUCIBLE E3 PROTEIN) (HA1520) LAM5
gacgtttatttcgagg

SEQ ID NO: 581 - DNA, 18 bp, Artificial Sequence
  Detection oligonucleotide for LYSOSOMAL-ASSOCIATED MULTITRANSMEMBRANE PROTEIN (RETINOIC ACID- INDUCIBLE E3 PROTEIN) (HA1520) LAM5
tgatgtttattttgaggt

SEQ ID NO: 582 - DNA, 16 bp, Artificial Sequence
  Detection oligonucleotide for LYSOSOMAL-ASSOCIATED MULTITRANSMEMBRANE PROTEIN (RETINOIC ACID- INDUCIBLE E3 PROTEIN) (HA1520) LAM5
tttgatcgggatgtga

SEQ ID NO: 583 - DNA, 16 bp, Artificial Sequence
  Detection oligonucleotide for LYSOSOMAL-ASSOCIATED MULTITRANSMEMBRANE PROTEIN (RETINOIC ACID- INDUCIBLE E3 PROTEIN) (HA1520) LAM5
tttgattgggatgtga

SEQ ID NO: 584 - DNA, 18 bp, Artificial Sequence
  Detection oligonucleotide for LYSOSOMAL-ASSOCIATED MULTITRANSMEMBRANE PROTEIN (RETINOIC ACID- INDUCIBLE E3 PROTEIN) (HA1520) LAM5
tgtaattgacgtttattt

SEQ ID NO: 585 - DNA, 20 bp, Artificial Sequence
  Detection oligonucleotide for LYSOSOMAL-ASSOCIATED MULTITRANSMEMBRANE PROTEIN (RETINOIC ACID- INDUCIBLE E3 PROTEIN) (HA1520) LAM5
aatgtaattgatgtttattt

SEQ ID NO: 586 - DNA, 16 bp, Artificial Sequence
  Detection oligonucleotide for "TYPE I INOSITOL-1,4,5-TRISPHOSPHATE 5-PHOSPHATASE (EC 3.1.3.56) (5PTASE)
atcggtgttagcggat

SEQ ID NO: 587 - DNA, 16 bp, Artificial Sequence
  Detection oligonucleotide for "TYPE I INOSITOL-1,4,5-TRISPHOSPHATE 5-PHOSPHATASE (EC 3.1.3.56) (5PTASE)
aattggtgttagtgga

SEQ ID NO: 588 - DNA, 17 bp, Artificial Sequence
  Detection oligonucleotide for "TYPE I INOSITOL-1,4,5-TRISPHOSPHATE 5-PHOSPHATASE (EC 3.1.3.56) (5PTASE)
atgttcgtaggtgtcgg

SEQ ID NO: 589 - DNA, 17 bp, Artificial Sequence
  Detection oligonucleotide for "TYPE I INOSITOL-1,4,5-TRISPHOSPHATE 5-PHOSPHATASE (EC 3.1.3.56) (5PTASE)
tttgtaggtgttgggta

SEQ ID NO: 590 - DNA, 16 bp, Artificial Sequence
  Detection oligonucleotide for "TYPE I INOSITOL-1,4,5-TRISPHOSPHATE 5-PHOSPHATASE (EC 3.1.3.56) (5PTASE)
gtcgttgttatcgagg

SEQ ID NO: 591 - DNA, 17 bp, Artificial Sequence
  Detection oligonucleotide for "TYPE I INOSITOL-1,4,5-TRISPHOSPHATE 5-PHOSPHATASE (EC 3.1.3.56) (5PTASE)
ggttgttgttattgagg

SEQ ID NO: 592 - DNA, 16 bp, Artificial Sequence
  Detection oligonucleotide for "TYPE I INOSITOL-1,4,5-TRISPHOSPHATE 5-PHOSPHATASE (EC 3.1.3.56) (5PTASE)
attgcggttttatcgg

SEQ ID NO: 593 - DNA, 17 bp, Artificial Sequence
  Detection oligonucleotide for "TYPE I INOSITOL-1,4,5-TRISPHOSPHATE 5-PHOSPHATASE (EC 3.1.3.56) (5PTASE)
attgtggttttattggt

SEQ ID NO: 594 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
ttcgatcggttgaata

SEQ ID NO: 595 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
ttgagttttgattggtt

SEQ ID NO: 596 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
taagtcgcgtaaggag

SEQ ID NO: 597 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
aagttgtgtaaggagta

SEQ ID NO: 598 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
aggttcgttaatcgtt

SEQ ID NO: 599 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
tgaggtttgttaattgt

SEQ ID NO: 600 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
tacgttggacgtatag

SEQ ID NO: 601 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
agagtatgttggatgta

SEQ ID NO: 602 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
agtcgcgagttatcga

SEQ ID NO: 603 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
agttgtgagttattgag

SEQ ID NO: 604 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
tagcgcgtcgtatata

SEQ ID NO: 605 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
ggagtagtgtgttgtat

SEQ ID NO: 606 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
gtcgaaagtcgttgag

SEQ ID NO: 607 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
gttgaaagttgttgagg

SEQ ID NO: 608 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
taggacgtatcgcgag

SEQ ID NO: 609 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
taggatgtattgtgagt

SEQ ID NO: 610 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
agtgtatcgtttttcgg

SEQ ID NO: 611 - DNA, 18 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
tagtgtattgttttttgg

SEQ ID NO: 612 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
ttcgtttacggtagtt

SEQ ID NO: 613 - DNA, 19 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
atttttgtttatggtagtt

SEQ ID NO: 614 - DNA, 16 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
tgcgtatcgttagtta

SEQ ID NO: 615 - DNA, 17 bp, Artificial Sequence
  Detection oligonucleotide for PROSTAGLANDIN E2 RECEPTOR, EP4 SUBTYPE (PROSTANOID EP4 RECEPTOR) (PGE RECEPTOR, EP4 SUBTYPE)
aggttgtgtattgttag

SEQ ID NO: 616 - DNA, 16 bp, Artificial Sequence
  Detection oligonucleotide for
attcggcgaatagtag

SEQ ID NO: 617 - DNA, 19 bp, Artificial Sequence
  Detection oligonucleotide for
tatttggtgaatagtagta

SEQ ID NO: 618 - DNA, 16 bp, Artificial Sequence
  Detection oligonucleotide for
atagcgttggtcgtta

SEQ ID NO: 619 - DNA, 17 bp, Artificial Sequence
  Detection oligonucleotide for
atagtgttggttgttag

SEQ ID NO: 620 - DNA, 16 bp, Artificial Sequence
  Detection oligonucleotide for
ttcgggatacgagttt

SEQ ID NO: 621 - DNA, 17 bp, Artificial Sequence
  Detection oligonucleotide for
gtttgggatatgagttt

SEQ ID NO: 622 - DNA, 16 bp, Artificial Sequence
  Detection oligonucleotide for
tacgataagtcggaga

SEQ ID NO: 623 - DNA, 17 bp, Artificial Sequence
  Detection oligonucleotide for
gggttatgataagttgg

SEQ ID NO: 624 - DNA, 16 bp, Artificial Sequence
  Detection oligonucleotide for
tatcggcgagttgtat

SEQ ID NO: 625 - DNA, 16 bp, Artificial Sequence
  Detection oligonucleotide for
ggttattggtgagttg

SEQ ID NO: 626 - DNA, 17 bp, Artificial Sequence
  Detection oligonucleotide for
ttaacgtttggggacgt

SEQ ID NO: 627 - DNA, 17 bp, Artificial Sequence
  Detection oligonucleotide for
ttaatgtttggggatgt

SEQ ID NO: 628 - DNA, 17 bp, Artificial Sequence
  Detection oligonucleotide for
tattcgcgtttttagat

SEQ ID NO: 629 - DNA, 20 bp, Artificial Sequence
  Detection oligonucleotide for
ttatttgtgtttttagatta

SEQ ID NO: 630 - DNA, 17 bp, Artificial Sequence
  Detection oligonucleotide for EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE
agggataacggaatatt

SEQ ID NO: 631 - DNA, 18 bp, Artificial Sequence
  Detection oligonucleotide for EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE
gaagggataatggaatat

SEQ ID NO: 632 - DNA, 17 bp, Artificial Sequence
  Detection oligonucleotide for EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE
gaatagtttcgagatga

SEQ ID NO: 633 - DNA, 18 bp, Artificial Sequence
  Detection oligonucleotide for EQUILIBRATIVE NUCLEOSIDE TRANSPORTER 1 (EQUILIBRATIVE NITROBENZYLMERCAPTOPURINE RIBOSIDE-SENSITIVE NUCLEOSIDE TRANSPORTER) (EQUILIBRATIVE NBMPR-SENSITIVE NUCLEOSIDE TRANSPORTER) (NUCLEOSIDE TRANSPORTER, ES-TYPE
ggaatagttttgagatga

SEQ ID NO: 634 - DNA, 16 bp, Artificial Sequence
  Detection oligonucleotide for ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR)
ttttcgacgaagtttt

SEQ ID NO: 635 - DNA, 18 bp, Artificial Sequence
  Detection oligonucleotide for ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR)
ttttgatgaagttttgtt

SEQ ID NO: 636 - DNA, 16 bp, Artificial Sequence
  Detection oligonucleotide for ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR)
ttacggaggcgtttta

SEQ ID NO: 637 - DNA, 17 bp, Artificial Sequence
  Detection oligonucleotide for ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR)
ttttatggaggtgtttt

SEQ ID NO: 638 - DNA, 16 bp, Artificial Sequence
  Detection oligonucleotide for ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR)
aggcgaatttatcggg

SEQ ID NO: 639 - DNA, 16 bp, Artificial Sequence
  Detection oligonucleotide for ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR)
ggtgaatttattgggg

SEQ ID NO: 640 - DNA, 16 bp, Artificial Sequence
  Detection oligonucleotide for ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR)
tagtcgaagtaggcgt

SEQ ID NO: 641 - DNA, 17 bp, Artificial Sequence
  Detection oligonucleotide for ORPHAN NUCLEAR RECEPTOR NR5A2 (ALPHA-1-FETOPROTEIN TRANSCRIPTION FACTOR) (HEPATOCYTIC TRANSCRIPTION FACTOR) (B1-BINDING FACTOR) (HB1F) (CYP7A PROMOTER BINDING FACTOR)
tagttgaagtaggtgtt

SEQ ID NO: 642 - DNA, 16 bp, Artificial Sequence
  Detection oligonucleotide for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
ttcgatcgaaggtaat

SEQ ID NO: 643 - DNA, 17 bp, Artificial Sequence
  Detection oligonucleotide for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
tttgtttgattgaaggt

SEQ ID NO: 644 - DNA, 16 bp, Artificial Sequence
  Detection oligonucleotide for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
aggcgatcgatattag

SEQ ID NO: 645 - DNA, 17 bp, Artificial Sequence
  Detection oligonucleotide for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
ggtgattgatattaggg

SEQ ID NO: 646 - DNA, 16 bp, Artificial Sequence
  Detection oligonucleotide for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
ttagcgttcgtcgtta

SEQ ID NO: 647 - DNA, 19 bp, Artificial Sequence
  Detection oligonucleotide for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
taattagtgtttgttgtta

SEQ ID NO: 648 - DNA, 16 bp, Artificial Sequence
  Detection oligonucleotide for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
atcggttcgggaattt

SEQ ID NO: 649 - DNA, 16 bp, Artificial Sequence
  Detection oligonucleotide for PROTEIN-TYROSINE PHOSPHATASE X PRECURSOR (EC 3.1.3.48) (R-PTP-X) (ISLET CELL AUTOANTIGEN RELATED PROTEIN) (ICAAR) (IAR) (PHOGRIN)
agattggtttgggaat

SEQ ID NO: 650 - DNA, 16 bp, Artificial Sequence
  Detection oligonucleotide for
gtcgatttcgttacgg

SEQ ID NO: 651 - DNA, 17 bp, Artificial Sequence
  Detection oligonucleotide for
gttgattttgttatggg

SEQ ID NO: 652 - DNA, 16 bp, Artificial Sequence
  Detection oligonucleotide for
ttcgggtttcgtatta

SEQ ID NO: 653 - DNA, 18 bp, Artificial Sequence
  Detection oligonucleotide for
ttttgggttttgtattag

SEQ ID NO: 654 - DNA, 16 bp, Artificial Sequence
  Detection oligonucleotide for
aattcgcggtttcgat

SEQ ID NO: 655 - DNA, 17 bp, Artificial Sequence
  Detection oligonucleotide for
aatttgtggttttgatg

SEQ ID NO: 656 - DNA, 16 bp, Artificial Sequence
  Detection oligonucleotide for
gtcgtttcgcggagat

SEQ ID NO: 657 - DNA, 17 bp, Artificial Sequence
  Detection oligonucleotide for
gttgttttgtggagatt

SEQ ID NO: 658 - DNA, 16 bp, Artificial Sequence
  Detection oligonucleotide for
attggtcgattcgcgg

SEQ ID NO: 659 - DNA, 17 bp, Artificial Sequence
  Detection oligonucleotide for
tattggttgatttgtgg

SEQ ID NO: 660 - DNA, 16 bp, Artificial Sequence
  Detection oligonucleotide for
agcgtttcgatttcgg

SEQ ID NO: 661 - DNA, 17 bp, Artificial Sequence
  Detection oligonucleotide for
agtgttttgattttggt

SEQ ID NO: 662 - DNA, 16 bp, Artificial Sequence
  Detection oligonucleotide for
atcgagcgtttcgatt

SEQ ID NO: 663 - DNA, 17 bp, Artificial Sequence
  Detection oligonucleotide for
ggattgagtgttttgat

SEQ ID NO: 664 - DNA, 16 bp, Artificial Sequence
  Detection oligonucleotide for
attcgcgtattcgaga

SEQ ID NO: 665 - DNA, 17 bp, Artificial Sequence
  Detection oligonucleotide for
tttgtgtatttgagagg

SEQ ID NO: 666 - DNA, 16 bp, Artificial Sequence
  Detection oligonucleotide for
gacgttcgcgattaaa

SEQ ID NO: 667 - DNA, 17 bp, Artificial Sequence
  Detection oligonucleotide for
tggatgtttgtgattaa

SEQ ID NO: 668 - DNA, 16 bp, Artificial Sequence
  Detection oligonucleotide for
aagtcgatatcgcggt

SEQ ID NO: 669 - DNA, 18 bp, Artificial Sequence
  Detection oligonucleotide for
aaaagttgatattgtggt

SEQ ID NO: 670 - DNA, 16 bp, Artificial Sequence
  Detection oligonucleotide for
agcgttcggaagttta

SEQ ID NO: 671 - DNA, 16 bp, Artificial Sequence
  Detection oligonucleotide for
ggagtgtttggaagtt

SEQ ID NO: 672 - DNA, 16 bp, Artificial Sequence
  Detection oligonucleotide for
tattcggacggggata

SEQ ID NO: 673 - DNA, 16 bp, Artificial Sequence
  Detection oligonucleotide for
atttggatggggatag

SEQ ID NO: 674 - DNA, 16 bp, Artificial Sequence
  Detection oligonucleotide for
gagacgcgtaggttat

SEQ ID NO: 675 - DNA, 16 bp, Artificial Sequence
  Detection oligonucleotide for
gggagatgtgtaggtt

SEQ ID NO: 676 - DNA, 16 bp, Artificial Sequence
  Detection oligonucleotide for
tagttttcggcgaagg

SEQ ID NO: 677 - DNA, 17 bp, Artificial Sequence
  Detection oligonucleotide for
ggtagtttttggtgaag

SEQ ID NO: 678 - DNA, 16 bp, Artificial Sequence
  Detection oligonucleotide for
aaggcggtgacgtaaa

SEQ ID NO: 679 - DNA, 16 bp, Artificial Sequence
  Detection oligonucleotide for
aaggtggtgatgtaaa

SEQ ID NO: 680 - DNA, 16 bp, Artificial Sequence
  Detection oligonucleotide for
atggcgtaagtacgtt

SEQ ID NO: 681 - DNA, 17 bp, Artificial Sequence
  Detection oligonucleotide for
gatggtgtaagtatgtt

SEQ ID NO: 682 - DNA, 16 bp, Artificial Sequence
  Detection oligonucleotide for
agtacgttcgggacga

SEQ ID NO: 683 - DNA, 17 bp, Artificial Sequence
  Detection oligonucleotide for
aagtatgtttgggatga

SEQ ID NO: 684 - DNA, 16 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
atggtattcgggtcgt

SEQ ID NO: 685 - DNA, 17 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
tatggtatttgggttgt

SEQ ID NO: 686 - DNA, 16 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
ttggagcgttaagtaa

SEQ ID NO: 687 - DNA, 18 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
tatttggagtgttaagta

SEQ ID NO: 688 - DNA, 17 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
tgaaagattcgtttgtt

SEQ ID NO: 689 - DNA, 18 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
gtgaaagatttgtttgtt

SEQ ID NO: 690 - DNA, 16 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
tgtataacgagaggtg

SEQ ID NO: 691 - DNA, 17 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
tgtataatgagaggtga

SEQ ID NO: 692 - DNA, 16 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
atgtttcgggtatgga

SEQ ID NO: 693 - DNA, 16 bp, Artificial Sequence
  Detection oligonucleotide for PEROXISOMAL MEMBRANE PROTEIN PEX14 (PEROXIN-14) (PEROXISOMAL MEMBRANE ANCHOR PROTEIN PEX14) (PTS1 RECEPTOR DOCKING PROTEIN)
atgttttgggtatgga

SEQ ID NO: 694 - DNA, 16 bp, Artificial Sequence
  Detection oligonucleotide for HOMEOBOX PROTEIN HOX-B6 (HOX-2B) (HOX-2.2)
ttttcgaggaattcgt

SEQ ID NO: 695 - DNA, 18 bp, Artificial Sequence
  Detection oligonucleotide for HOMEOBOX PROTEIN HOX-B6 (HOX-2B) (HOX-2.2)
ttttttgaggaatttgtt

SEQ ID NO: 696 - DNA, 16 bp, Artificial Sequence
  Detection oligonucleotide for HOMEOBOX PROTEIN HOX-B6 (HOX-2B) (HOX-2.2)
atagttttcggcgggt

SEQ ID NO: 697 - DNA, 17 bp, Artificial Sequence
  Detection oligonucleotide for HOMEOBOX PROTEIN HOX-B6 (HOX-2B) (HOX-2.2)
tatagtttttggtgggt

SEQ ID NO: 698 - DNA, 16 bp, Artificial Sequence
  Detection oligonucleotide for HOMEOBOX PROTEIN HOX-B6 (HOX-2B) (HOX-2.2)
tttttcggcgtagata

SEQ ID NO: 699 - DNA, 17 bp, Artificial Sequence
  Detection oligonucleotide for HOMEOBOX PROTEIN HOX-B6 (HOX-2B) (HOX-2.2)
tgttttttggtgtagat

SEQ ID NO: 700 - DNA, 16 bp, Artificial Sequence
  Detection oligonucleotide for HOMEOBOX PROTEIN HOX-B6 (HOX-2B) (HOX-2.2)
ttacgggcgttagaga

SEQ ID NO: 701 - DNA, 16 bp, Artificial Sequence
  Detection oligonucleotide for HOMEOBOX PROTEIN HOX-B6 (HOX-2B) (HOX-2.2)
ggagttatgggtgtta

SEQ ID NO: 702 - DNA, 16 bp, Artificial Sequence
  Detection oligonucleotide for LIM DOMAIN KINASE 1 (EC 2.7.1.37) (LIMK-1)
tatcggattatcgcgg

SEQ ID NO: 703 - DNA, 17 bp, Artificial Sequence
  Detection oligonucleotide for LIM DOMAIN KINASE 1 (EC 2.7.1.37) (LIMK-1)
attggattattgtgggg

SEQ ID NO: 704 - DNA, 18 bp, Artificial Sequence
  Detection oligonucleotide for LIM DOMAIN KINASE 1 (EC 2.7.1.37) (LIMK-1)
gtcggtagtttatcggat

SEQ ID NO: 705 - DNA, 18 bp, Artificial Sequence
  Detection oligonucleotide for LIM DOMAIN KINASE 1 (EC 2.7.1.37) (LIMK-1)
gttggtagtttattggat

SEQ ID NO: 706 - DNA, 16 bp, Artificial Sequence
  Detection oligonucleotide for LIM DOMAIN KINASE 1 (EC 2.7.1.37) (LIMK-1)
taggagacgttacgtt

SEQ ID NO: 707 - DNA, 17 bp, Artificial Sequence
  Detection oligonucleotide for LIM DOMAIN KINASE 1 (EC 2.7.1.37) (LIMK-1)
agatgttatgttagggt

SEQ ID NO: 708 - DNA, 16 bp, Artificial Sequence
  Detection oligonucleotide for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
aagaacggacgtgttt

SEQ ID NO: 709 - DNA, 16 bp, Artificial Sequence
  Detection oligonucleotide for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
aggaagaatggatgtg

SEQ ID NO: 710 - DNA, 16 bp, Artificial Sequence
  Detection oligonucleotide for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
tttttgcgatagtcgg

SEQ ID NO: 711 - DNA, 17 bp, Artificial Sequence
  Detection oligonucleotide for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
gtttttgtgatagttgg

SEQ ID NO: 712 - DNA, 16 bp, Artificial Sequence
  Detection oligonucleotide for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
tagcggcgatttaagg

SEQ ID NO: 713 - DNA, 17 bp, Artificial Sequence
  Detection oligonucleotide for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
gtagtggtgatttaagg

SEQ ID NO: 714 - DNA, 16 bp, Artificial Sequence
  Detection oligonucleotide for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
tttacgagcgagtcgt

SEQ ID NO: 715 - DNA, 18 bp, Artificial Sequence
  Detection oligonucleotide for LOW AFFINITY IMMUNOGLOBULIN GAMMA FC REGION RECEPTOR II-A PRECURSOR (FC-GAMMA RII-A) (FCRII-A) (IGG FC RECEPTOR II-A) (FC-GAMMA-RIIA) (CD32) (CDW32)
ttttatgagtgagttgtt

SEQ ID NO: 716 - DNA, 17 bp, Artificial Sequence
  Detection oligonucleotide for 1-ACYL-SN-GLYCEROL-3-PHOSPHATE ACYLTRANSFERASE GAMMA (EC 2.3.1.51) (1- AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O- ACYLTRANSFERASE 3)
tttcgatagtatacggg

SEQ ID NO: 717 - DNA, 18 bp, Artificial Sequence
  Detection oligonucleotide for 1-ACYL-SN-GLYCEROL-3-PHOSPHATE ACYLTRANSFERASE GAMMA (EC 2.3.1.51) (1- AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O- ACYLTRANSFERASE 3)
tttgatagtatatgggga

SEQ ID NO: 718 - DNA, 16 bp, Artificial Sequence
  Detection oligonucleotide for 1-ACYL-SN-GLYCEROL-3-PHOSPHATE ACYLTRANSFERASE GAMMA (EC 2.3.1.51) (1- AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O- ACYLTRANSFERASE 3)
aagggagcgttcgtta

SEQ ID NO: 719 - DNA, 16 bp, Artificial Sequence
  Detection oligonucleotide for 1-ACYL-SN-GLYCEROL-3-PHOSPHATE ACYLTRANSFERASE GAMMA (EC 2.3.1.51) (1- AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O- ACYLTRANSFERASE 3)
aagggagtgtttgtta

SEQ ID NO: 720 - DNA, 16 bp, Artificial Sequence
  Detection oligonucleotide for 1-ACYL-SN-GLYCEROL-3-PHOSPHATE ACYLTRANSFERASE GAMMA (EC 2.3.1.51) (1- AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O- ACYLTRANSFERASE 3)
aataatagcgacgggg

SEQ ID NO: 721 - DNA, 16 bp, Artificial Sequence
  Detection oligonucleotide for 1-ACYL-SN-GLYCEROL-3-PHOSPHATE ACYLTRANSFERASE GAMMA (EC 2.3.1.51) (1- AGP ACYLTRANSFERASE 3) (1-AGPAT 3) (LYSOPHOSPHATIDIC ACID ACYLTRANSFERASE-GAMMA) (LPAAT-GAMMA) (1-ACYLGLYCEROL-3-PHOSPHATE O- ACYLTRANSFERASE 3)
taatagtgatgggggt

SEQ ID NO: 722 - DNA, 16 bp, Artificial Sequence
  Detection oligonucleotide for HOMEOBOX PROTEIN GSH-2
tttagaatcgtcgagt

SEQ ID NO: 723 - DNA, 17 bp, Artificial Sequence
  Detection oligonucleotide for HOMEOBOX PROTEIN GSH-2
agaattgttgagtgaag

SEQ ID NO: 724 - DNA, 17 bp, Artificial Sequence
  Detection oligonucleotide for HOMEOBOX PROTEIN GSH-2
tttttcgtcggttcgta

SEQ ID NO: 725 - DNA, 17 bp, Artificial Sequence
  Detection oligonucleotide for HOMEOBOX PROTEIN GSH-2
tttgttggtttgtagga

SEQ ID NO: 726 - DNA, 16 bp, Artificial Sequence
  Detection oligonucleotide for HOMEOBOX PROTEIN GSH-2
aggacggcgtttatta

SEQ ID NO: 727 - DNA, 16 bp, Artificial Sequence
  Detection oligonucleotide for HOMEOBOX PROTEIN GSH-2
gatgaggatggtgttt

SEQ ID NO: 728 - DNA, 16 bp, Artificial Sequence
  Detection oligonucleotide for HOMEOBOX PROTEIN GSH-2
ttcgatttcggaggat

SEQ ID NO: 729 - DNA, 17 bp, Artificial Sequence
  Detection oligonucleotide for HOMEOBOX PROTEIN GSH-2
tttgattttggaggatt

SEQ ID NO: 730 - DNA, 16 bp, Artificial Sequence
  Detection oligonucleotide for
ttcgttatcgagagtt

SEQ ID NO: 731 - DNA, 17 bp, Artificial Sequence
  Detection oligonucleotide for
gggttttgttattgaga

SEQ ID NO: 732 - DNA, 16 bp, Artificial Sequence
  Detection oligonucleotide for
gacgtgagcgtttagg

SEQ ID NO: 733 - DNA, 17 bp, Artificial Sequence
  Detection oligonucleotide for
gatgtgagtgtttaggg

SEQ ID NO: 734 - DNA, 16 bp, Artificial Sequence
  Detection oligonucleotide for
tacggagttggcgtta

SEQ ID NO: 735 - DNA, 16 bp, Artificial Sequence
  Detection oligonucleotide for
tttatggagttggtgt

SEQ ID NO: 736 - DNA, 16 bp, Artificial Sequence
  Detection oligonucleotide for
ttggttcgtcgaggat

SEQ ID NO: 737 - DNA, 16 bp, Artificial Sequence
  Detection oligonucleotide for
ttggtttgttgaggat

SEQ ID NO: 738 - DNA, 16 bp, Artificial Sequence
  Detection oligonucleotide for HISTONE H4
atcgaaatcgtagagg

SEQ ID NO: 739 - DNA, 17 bp, Artificial Sequence
  Detection oligonucleotide for HISTONE H4
attgaaattgtagaggg

SEQ ID NO: 740 - DNA, 16 bp, Artificial Sequence
  Detection oligonucleotide for HISTONE H4
tatggcggtgatcgtt

SEQ ID NO: 741 - DNA, 17 bp, Artificial Sequence
  Detection oligonucleotide for HISTONE H4
tttatggtggtgattgt

SEQ ID NO: 742 - DNA, 16 bp, Artificial Sequence
  Detection oligonucleotide for HISTONE H4
ttacggcgtttcggat

SEQ ID NO: 743 - DNA, 17 bp, Artificial Sequence
  Detection oligonucleotide for HISTONE H4
ttatggtgttttggatt

SEQ ID NO: 744 - DNA, 16 bp, Artificial Sequence
  Detection oligonucleotide for HISTONE H4
atgcgttttacgtcgt

SEQ ID NO: 745 - DNA, 18 bp, Artificial Sequence
  Detection oligonucleotide for HISTONE H4
agatgtgttttatgttgt

SEQ ID NO: 746 - DNA, 16 bp, Artificial Sequence
  Detection oligonucleotide for HISTONE H4
taaggcgtcggatggt

SEQ ID NO: 747 - DNA, 16 bp, Artificial Sequence
  Detection oligonucleotide for HISTONE H4
gagtaaggtgttggat

SEQ ID NO: 748 - DNA, 16 bp, Artificial Sequence
  Detection oligonucleotide for HISTONE H4
tattttacggtggcgt

SEQ ID NO: 749 - DNA, 17 bp, Artificial Sequence
  Detection oligonucleotide for HISTONE H4
attttatggtggtgttt

SEQ ID NO: 750 - DNA, 16 bp, Artificial Sequence
  Detection oligonucleotide for POTASSIUM VOLTAGE-GATED CHANNEL SUBFAMILY KQT MEMBER 2 (NEUROBLASTOMA- SPECIFIC POTASSIUM CHANNEL KQT-LIKE 2)
atttcggaggtatcgt

SEQ ID NO: 751 - DNA, 16 bp, Artificial Sequence
  Detection oligonucleotide for POTASSIUM VOLTAGE-GATED CHANNEL SUBFAMILY KQT MEMBER 2 (NEUROBLASTOMA- SPECIFIC POTASSIUM CHANNEL KQT-LIKE 2)
tttggaggtattgtgt

SEQ ID NO: 752 - DNA, 16 bp, Artificial Sequence
  Detection oligonucleotide for POTASSIUM VOLTAGE-GATED CHANNEL SUBFAMILY KQT MEMBER 2 (NEUROBLASTOMA- SPECIFIC POTASSIUM CHANNEL KQT-LIKE 2)
ttcgtacggggtatag

SEQ ID NO: 753 - DNA, 17 bp, Artificial Sequence
  Detection oligonucleotide for POTASSIUM VOLTAGE-GATED CHANNEL SUBFAMILY KQT MEMBER 2 (NEUROBLASTOMA- SPECIFIC POTASSIUM CHANNEL KQT-LIKE 2)
ggtttgtatggggtata

SEQ ID NO: 754 - DNA, 16 bp, Artificial Sequence
  Detection oligonucleotide for POTASSIUM VOLTAGE-GATED CHANNEL SUBFAMILY KQT MEMBER 2 (NEUROBLASTOMA- SPECIFIC POTASSIUM CHANNEL KQT-LIKE 2)
tataaggcgttacggt

SEQ ID NO: 755 - DNA, 17 bp, Artificial Sequence
  Detection oligonucleotide for POTASSIUM VOLTAGE-GATED CHANNEL SUBFAMILY KQT MEMBER 2 (NEUROBLASTOMA- SPECIFIC POTASSIUM CHANNEL KQT-LIKE 2)
ggtataaggtgttatgg

SEQ ID NO: 756 - DNA, 16 bp, Artificial Sequence
  Detection oligonucleotide for POTASSIUM VOLTAGE-GATED CHANNEL SUBFAMILY KQT MEMBER 2 (NEUROBLASTOMA- SPECIFIC POTASSIUM CHANNEL KQT-LIKE 2)
ttacggtcgcgtagta

SEQ ID NO: 757 - DNA, 17 bp, Artificial Sequence
  Detection oligonucleotide for POTASSIUM VOLTAGE-GATED CHANNEL SUBFAMILY KQT MEMBER 2 (NEUROBLASTOMA- SPECIFIC POTASSIUM CHANNEL KQT-LIKE 2)
tatggttgtgtagtagt

SEQ ID NO: 758 - DNA, 17 bp, Artificial Sequence
  Synthetic construct
ttattcgtagttttcgg

SEQ ID NO: 759 - DNA, 19 bp, Artificial Sequence
  Synthetic construct
gtttatttgtagtttttgg

SEQ ID NO: 760 - DNA, 17 bp, Artificial Sequence
  Synthetic construct
tgtaatcgtttattcgt

SEQ ID NO: 761 - DNA, 20 bp, Artificial Sequence
  Synthetic construct
taattgtttatttgtagttt

SEQ ID NO: 762 - DNA, 16 bp, Artificial Sequence
  Synthetic construct
ttcgaagtcgggatta

SEQ ID NO: 763 - DNA, 17 bp, Artificial Sequence
  Synthetic construct
attttgaagttgggatt

SEQ ID NO: 764 - DNA, 18 bp, Artificial Sequence
  Synthetic construct
atcgagagtatttcgaag

SEQ ID NO: 765 - DNA, 18 bp, Artificial Sequence
  Synthetic construct
ggattgagagtattttga

SEQ ID NO: 766 - DNA, 17 bp, Artificial Sequence
  Detection oligonucleotide for
taagcggtataagtcgg

SEQ ID NO: 767 - DNA, 17 bp, Artificial Sequence
  Detection oligonucleotide for
agtggtataagttggtt

SEQ ID NO: 768 - DNA, 16 bp, Artificial Sequence
  Detection oligonucleotide for
ttcggtaagcggtata

SEQ ID NO: 769 - DNA, 18 bp, Artificial Sequence
  Detection oligonucleotide for
ataatttggtaagtggta

SEQ ID NO: 770 - DNA, 17 bp, Artificial Sequence
  Detection oligonucleotide for
ttcgtgattttacgtta

SEQ ID NO: 771 - DNA, 19 bp, Artificial Sequence
  Detection oligonucleotide for
aattttgtgattttatgtt

SEQ ID NO: 772 - DNA, 16 bp, Artificial Sequence
  Detection oligonucleotide for
tggcgacgaagtgtaa

SEQ ID NO: 773 - DNA, 16 bp, Artificial Sequence
  Detection oligonucleotide for
tttgtggtgatgaagt

SEQ ID NO: 774 - DNA, 16 bp, Artificial Sequence
  Detection oligonucleotide for
tagcgggtttacggag

SEQ ID NO: 775 - DNA, 16 bp, Artificial Sequence
  Detection oligonucleotide for
agtagtgggtttatgg

SEQ ID NO: 776 - DNA, 16 bp, Artificial Sequence
  Detection oligonucleotide for
taacgagtcgagcgga

SEQ ID NO: 777 - DNA, 16 bp, Artificial Sequence
  Detection oligonucleotide for
aatgagttgagtggag

SEQ ID NO: 778 - DNA, 16 bp, Artificial Sequence
  Detection oligonucleotide for
ttttcgcgtgtaagtt

SEQ ID NO: 779 - DNA, 18 bp, Artificial Sequence
  Detection oligonucleotide for
tttttgtgtgtaagttaa

SEQ ID NO: 780 - DNA, 16 bp, Artificial Sequence
  Detection oligonucleotide for
taggacgattcggata

SEQ ID NO: 781 - DNA, 17 bp, Artificial Sequence
  Detection oligonucleotide for
aggatgatttggatagt

SEQ ID NO: 782 - DNA, 17 bp, Artificial Sequence
  Detection oligonucleotide for
ttcgagtgaaagcggta

SEQ ID NO: 783 - DNA, 17 bp, Artificial Sequence
  Detection oligonucleotide for
tttgagtgaaagtggta

SEQ ID NO: 784 - DNA, 17 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
ttacgttttcgtgaaat

SEQ ID NO: 785 - DNA, 19 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
ttttatgtttttgtgaaat

SEQ ID NO: 786 - DNA, 16 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
gggaggacgtagagta

SEQ ID NO: 787 - DNA, 16 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
gggaggatgtagagta

SEQ ID NO: 788 - DNA, 18 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
tgggttatcgtttatatt

SEQ ID NO: 789 - DNA, 19 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
ttgggttattgtttatatt

SEQ ID NO: 790 - DNA, 17 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
tggtatcggtttttgaa

SEQ ID NO: 791 - DNA, 17 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
tggtattggtttttgaa

SEQ ID NO: 792 - DNA, 17 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
gtttaggttcgagttta

SEQ ID NO: 793 - DNA, 18 bp, Artificial Sequence
  Detection oligonucleotide for PERIPLAKIN (195 KDA CORNIFIED ENVELOPE PRECURSOR) (190 KDA PARANEOPLASTIC PEMPHIGUS ANTIGEN)
ggtttaggtttgagttta

SEQ ID NO: 794 - DNA, 16 bp, Artificial Sequence
  Detection oligonucleotide for
agaattgcgacggttt

SEQ ID NO: 795 - DNA, 17 bp, Artificial Sequence
  Detection oligonucleotide for
aattgtgatggtttgta

SEQ ID NO: 796 - DNA, 17 bp, Artificial Sequence
  Detection oligonucleotide for
ttacgtttatttacggg

SEQ ID NO: 797 - DNA, 19 bp, Artificial Sequence
  Detection oligonucleotide for
tatgtttatttatggggat

SEQ ID NO: 798 - DNA, 16 bp, Artificial Sequence
  Detection oligonucleotide for
tggatgtgcggaagaa

SEQ ID NO: 799 - DNA, 16 bp, Artificial Sequence
  Detection oligonucleotide for
gatgtgtggaagaagt

SEQ ID NO: 800 - DNA, 16 bp, Artificial Sequence
  Detection oligonucleotide for
atgggtacgttgttta

SEQ ID NO: 801 - DNA, 18 bp, Artificial Sequence
  Detection oligonucleotide for
tatgggtatgttgtttat

SEQ ID NO: 802 - DNA, 17 bp, Artificial Sequence
  Detection oligonucleotide for
ggatatttgcgttagta

SEQ ID NO: 803 - DNA, 19 bp, Artificial Sequence
  Detection oligonucleotide for
ggatatttgtgttagtatt

SEQ ID NO: 804 - DNA, 17 bp, Artificial Sequence
  Detection oligonucleotide for
gacgtgttcgggtttta

SEQ ID NO: 805 - DNA, 17 bp, Artificial Sequence
  Detection oligonucleotide for
gatgtgtttgggtttta

SEQ ID NO: 806 - DNA, 16 bp, Artificial Sequence
  Detection oligonucleotide for
agtcgacggtttgagg

SEQ ID NO: 807 - DNA, 16 bp, Artificial Sequence
  Detection oligonucleotide for
agttgatggtttgagg

SEQ ID NO: 808 - DNA, 17 bp, Artificial Sequence
  Detection oligonucleotide for
ttattgcgttgttaagt

SEQ ID NO: 809 - DNA, 18 bp, Artificial Sequence
  Detection oligonucleotide for
gttattgtgttgttaagt

SEQ ID NO: 810 - DNA, 16 bp, Artificial Sequence
  Detection oligonucleotide for
atttaaacggggtcgt

SEQ ID NO: 811 - DNA, 17 bp, Artificial Sequence
  Detection oligonucleotide for
aatttaaatggggttgt

SEQ ID NO: 812 - DNA, 21 bp, Artificial Sequence
  Detection oligonucleotide for
atcggttttttgtatcgaata

SEQ ID NO: 813 - DNA, 21 bp, Artificial Sequence
  Detection oligonucleotide for
attggttttttgtattgaata

SEQ ID NO: 814 - DNA, 16 bp, Artificial Sequence
  Detection oligonucleotide for
ttcggcgttttcgtag

SEQ ID NO: 815 - DNA, 16 bp, Artificial Sequence
  Detection oligonucleotide for
tgaaagttcggcgttt

SEQ ID NO: 816 - DNA, 17 bp, Artificial Sequence
  Detection oligonucleotide for
tttggtgtttttgtagg

SEQ ID NO: 817 - DNA, 17 bp, Artificial Sequence
  Detection oligonucleotide for
tgaaagtttggtgtttt

SEQ ID NO: 818 - DNA, 16 bp, Artificial Sequence
  Detection oligonucleotide for
atcggtttttcgaggt

SEQ ID NO: 819 - DNA, 17 bp, Artificial Sequence
  Detection oligonucleotide for
attggttttttgaggtt

SEQ ID NO: 820 - DNA, 16 bp, Artificial Sequence
  Detection oligonucleotide for
ggtcgattttcgcgta

SEQ ID NO: 821 - DNA, 17 bp, Artificial Sequence
  Detection oligonucleotide for
tggttgatttttgtgta

SEQ ID NO: 822 - DNA, 16 bp, Artificial Sequence
  Detection oligonucleotide for
ggtaatttcgcgtatt

SEQ ID NO: 823 - DNA, 19 bp, Artificial Sequence
  Detection oligonucleotide for
ttggtaattttgtgtattt

SEQ ID NO: 824 - DNA, 16 bp, Artificial Sequence
  Detection oligonucleotide for
tatgcgtatacgtggt

SEQ ID NO: 825 - DNA, 18 bp, Artificial Sequence
  Detection oligonucleotide for
atgtgtatatgtggtttt

SEQ ID NO: 826 - DNA, 16 bp, Artificial Sequence
  Detection oligonucleotide for
gtcgttttatgcgtat

SEQ ID NO: 827 - DNA, 18 bp, Artificial Sequence
  Detection oligonucleotide for
tggttgttttatgtgtat

SEQ ID NO: 828 - DNA, 17 bp, Artificial Sequence
  Detection oligonucleotide for
tagttttcgaatttcgt

SEQ ID NO: 829 - DNA, 19 bp, Artificial Sequence
  Detection oligonucleotide for
attagtttttgaattttgt

SEQ ID NO: 830 - DNA, 16 bp, Artificial Sequence
  Detection oligonucleotide for
tagcgagggtcgtttt

SEQ ID NO: 831 - DNA, 16 bp, Artificial Sequence
  Detection oligonucleotide for
tagtgagggttgtttt

SEQ ID NO: 832 - DNA, 16 bp, Artificial Sequence
  Detection oligonucleotide for
ttaggtcgcgtcggta

SEQ ID NO: 833 - DNA, 16 bp, Artificial Sequence
  Detection oligonucleotide for
aggttgtgttggtaga

SEQ ID NO: 834 - DNA, 16 bp, Artificial Sequence
  Detection oligonucleotide for
atttcgtttacgtcgt

SEQ ID NO: 835 - DNA, 18 bp, Artificial Sequence
  Detection oligonucleotide for
ggattttgtttatgttgt

SEQ ID NO: 836 - DNA, 16 bp, Artificial Sequence
  Detection oligonucleotide for
ttttcgtattcgggta

SEQ ID NO: 837 - DNA, 18 bp, Artificial Sequence
  Detection oligonucleotide for
tttgtatttgggtaaaag

SEQ ID NO: 838 - DNA, 16 bp, Artificial Sequence
  Detection oligonucleotide for
aggatcgggattcgta

SEQ ID NO: 839 - DNA, 17 bp, Artificial Sequence
  Detection oligonucleotide for
aggattgggatttgtag

SEQ ID NO: 840 - DNA, 16 bp, Artificial Sequence
  Detection oligonucleotide for
ttcgtttaagcggggt

SEQ ID NO: 841 - DNA, 16 bp, Artificial Sequence
  Detection oligonucleotide for
tttgtttaagtggggt

SEQ ID NO: 842 - DNA, 16 bp, Artificial Sequence
  Detection oligonucleotide for
atattcgtgcggtcgg

SEQ ID NO: 843 - DNA, 17 bp, Artificial Sequence
  Detection oligonucleotide for
atatttgtgtggttgga

SEQ ID NO: 844 - DNA, 16 bp, Artificial Sequence
  Detection oligonucleotide for
ttaggtcgtggaatgt

SEQ ID NO: 845 - DNA, 16 bp, Artificial Sequence
  Detection oligonucleotide for
ttaggttgtggaatgt

SEQ ID NO: 846 - DNA, 16 bp, Artificial Sequence
  Detection oligonucleotide for
aggaatcgtgagtagg

SEQ ID NO: 847 - DNA, 16 bp, Artificial Sequence
  Detection oligonucleotide for
aggaattgtgagtagg

SEQ ID NO: 848 - DNA, 16 bp, Artificial Sequence
  Detection oligonucleotide for DNA REPLICATION FACTOR; DOUBLE PARKED, DROSOPHILA, HOMOLOG OF
ttcgatatcgagtcgg

SEQ ID NO: 849 - DNA, 18 bp, Artificial Sequence
  Detection oligonucleotide for DNA REPLICATION FACTOR; DOUBLE PARKED, DROSOPHILA, HOMOLOG OF
atttgatattgagttggt

SEQ ID NO: 850 - DNA, 16 bp, Artificial Sequence
  Detection oligonucleotide for DNA REPLICATION FACTOR; DOUBLE PARKED, DROSOPHILA, HOMOLOG OF
attcgcgttttaacgt

SEQ ID NO: 851 - DNA, 18 bp, Artificial Sequence
  Detection oligonucleotide for DNA REPLICATION FACTOR; DOUBLE PARKED, DROSOPHILA, HOMOLOG OF
tttgtgttttaatgtgga

SEQ ID NO: 852 - DNA, 16 bp, Artificial Sequence
  Detection oligonucleotide for DNA REPLICATION FACTOR; DOUBLE PARKED, DROSOPHILA, HOMOLOG OF
ttcggttgggacgtaa

SEQ ID NO: 853 - DNA, 16 bp, Artificial Sequence
  Detection oligonucleotide for DNA REPLICATION FACTOR; DOUBLE PARKED, DROSOPHILA, HOMOLOG OF
tttggttgggatgtaa

SEQ ID NO: 854 - DNA, 16 bp, Artificial Sequence
  Detection oligonucleotide for DNA REPLICATION FACTOR; DOUBLE PARKED, DROSOPHILA, HOMOLOG OF
ttaaggcgtttagcga

SEQ ID NO: 855 - DNA, 18 bp, Artificial Sequence
  Detection oligonucleotide for DNA REPLICATION FACTOR; DOUBLE PARKED, DROSOPHILA, HOMOLOG OF
ttttaaggtgtttagtga

SEQ ID NO: 856 - DNA, 16 bp, Artificial Sequence
  Detection oligonucleotide for PR-DOMAIN ZINC FINGER PROTEIN 16 (TRANSCRIPTION FACTOR MEL1)
tatcgtcgagtgtgta

SEQ ID NO: 857 - DNA, 16 bp, Artificial Sequence
  Detection oligonucleotide for PR-DOMAIN ZINC FINGER PROTEIN 16 (TRANSCRIPTION FACTOR MEL1)
ggggttattgttgagt

SEQ ID NO: 858 - DNA, 18 bp, Artificial Sequence
  Detection oligonucleotide for PR-DOMAIN ZINC FINGER PROTEIN 16 (TRANSCRIPTION FACTOR MEL1)
tattattcgagttagagg

SEQ ID NO: 859 - DNA, 19 bp, Artificial Sequence
  Detection oligonucleotide for PR-DOMAIN ZINC FINGER PROTEIN 16 (TRANSCRIPTION FACTOR MEL1)
ttattatttgagttagagg

SEQ ID NO: 860 - DNA, 16 bp, Artificial Sequence
  Detection oligonucleotide for PR-DOMAIN ZINC FINGER PROTEIN 16 (TRANSCRIPTION FACTOR MEL1)
aggattcgttgaagaa

SEQ ID NO: 861 - DNA, 17 bp, Artificial Sequence
  Detection oligonucleotide for PR-DOMAIN ZINC FINGER PROTEIN 16 (TRANSCRIPTION FACTOR MEL1)
gtaggatttgttgaaga

SEQ ID NO: 862 - DNA, 19 bp, Artificial Sequence
  Detection oligonucleotide for PR-DOMAIN ZINC FINGER PROTEIN 16 (TRANSCRIPTION FACTOR MEL1)
ttattaggcgatattttaa

SEQ ID NO: 863 - DNA, 20 bp, Artificial Sequence
  Detection oligonucleotide for PR-DOMAIN ZINC FINGER PROTEIN 16 (TRANSCRIPTION FACTOR MEL1)
tattaggtgatattttaagt

SEQ ID NO: 864 - DNA, 16 bp, Artificial Sequence
  Synthetic construct
tagtacgttggttcgg

SEQ ID NO: 865 - DNA, 16 bp, Artificial Sequence
  Synthetic construct
tatgttggtttggagt

SEQ ID NO: 866 - DNA, 17 bp, Artificial Sequence
  Synthetic construct
agttgttcgatgattag

SEQ ID NO: 867 - DNA, 19 bp, Artificial Sequence
  Synthetic construct
tttagttgtttgatgatta

SEQ ID NO: 868 - DNA, 17 bp, Artificial Sequence
  Synthetic construct
agattagtacgttggtt

SEQ ID NO: 869 - DNA, 18 bp, Artificial Sequence
  Synthetic construct
aagattagtatgttggtt

SEQ ID NO: 870 - DNA, 16 bp, Artificial Sequence
  Synthetic construct
ttaaagcggggagttt

SEQ ID NO: 871 - DNA, 16 bp, Artificial Sequence
  Synthetic construct
gtttaaagtggggagt

SEQ ID NO: 872 - DNA, 17 bp, Artificial Sequence
  Synthetic construct
agatggtatcgtttagg

SEQ ID NO: 873 - DNA, 17 bp, Artificial Sequence
  Synthetic construct
atggtattgtttaggtg

SEQ ID NO: 874 - DNA, 16 bp, Artificial Sequence
  Detection oligonucleotide for CDH1
tatcgcgtttatgcga

SEQ ID NO: 875 - DNA, 17 bp, Artificial Sequence
  Detection oligonucleotide for CDH1
attgtgtttatgtgagg

SEQ ID NO: 876 - DNA, 16 bp, Artificial Sequence
  Detection oligonucleotide for CDH1
ttatgcgaggtcgggt

SEQ ID NO: 877 - DNA, 16 bp, Artificial Sequence
  Detection oligonucleotide for CDH1
ttatgtgaggttgggt

SEQ ID NO: 878 - DNA, 16 bp, Artificial Sequence
  Detection oligonucleotide for CDH1
ttaattagcggtacgg

SEQ ID NO: 879 - DNA, 16 bp, Artificial Sequence
  Detection oligonucleotide for CDH1
aattagtggtatgggg

SEQ ID NO: 880 - DNA, 16 bp, Artificial Sequence
  Detection oligonucleotide for CDH1
tagtggcgtcggaatt

SEQ ID NO: 881 - DNA, 16 bp, Artificial Sequence
  Detection oligonucleotide for CDH1
tagtggtgttggaatt

SEQ ID NO: 882 - DNA, 17 bp, Artificial Sequence
  Detection oligonucleotide for CDKN2a
ggcgttgtttaacgtat

SEQ ID NO: 883 - DNA, 17 bp, Artificial Sequence
  Detection oligonucleotide for CDKN2a
gggtgttgtttaatgta

SEQ ID NO: 884 - DNA, 17 bp, Artificial Sequence
  Detection oligonucleotide for CDKN2a
tgtttaacgtatcgaat

SEQ ID NO: 885 - DNA, 19 bp, Artificial Sequence
  Detection oligonucleotide for CDKN2a
gttgtttaatgtattgaat

SEQ ID NO: 886 - DNA, 16 bp, Artificial Sequence
  Detection oligonucleotide for CDKN2a
aatagttacggtcgga

SEQ ID NO: 887 - DNA, 16 bp, Artificial Sequence
  Detection oligonucleotide for CDKN2a
agttatggttggaggt

SEQ ID NO: 888 - DNA, 16 bp, Artificial Sequence
  Detection oligonucleotide for CDKN2a
gtcggaggtcgattta

SEQ ID NO: 889 - DNA, 17 bp, Artificial Sequence
  Detection oligonucleotide for CDKN2a
ggttggaggttgattta

SEQ ID NO: 890 - DNA, 16 bp, Artificial Sequence
  Detection oligonucleotide for CD44
aggtatttcgcgatat

SEQ ID NO: 891 - DNA, 19 bp, Artificial Sequence
  Detection oligonucleotide for CD44
aggtattttgtgatatttt

SEQ ID NO: 892 - DNA, 17 bp, Artificial Sequence
  Detection oligonucleotide for CD44
taggttcggttcgttat

SEQ ID NO: 893 - DNA, 18 bp, Artificial Sequence
  Detection oligonucleotide for CD44
taggtttggtttgttatt

SEQ ID NO: 894 - DNA, 17 bp, Artificial Sequence
  Detection oligonucleotide for CD44
gttcgtttcggatatta

SEQ ID NO: 895 - DNA, 19 bp, Artificial Sequence
  Detection oligonucleotide for CD44
tttgttttggatattatgg

SEQ ID NO: 896 - DNA, 16 bp, Artificial Sequence
  Detection oligonucleotide for CD44
tttggcgtagatcggt

SEQ ID NO: 897 - DNA, 16 bp, Artificial Sequence
  Detection oligonucleotide for CD44
tttggtgtagattggt

SEQ ID NO: 898 - DNA, 16 bp, Artificial Sequence
  Detection oligonucleotide for CD44
tttagcgcggattcgg

SEQ ID NO: 899 - DNA, 17 bp, Artificial Sequence
  Detection oligonucleotide for CD44
gtttagtgtggatttgg

SEQ ID NO: 900 - DNA, 16 bp, Artificial Sequence
  Detection oligonucleotide for GSTP1
atcgttgcgatttcgg

SEQ ID NO: 901 - DNA, 17 bp, Artificial Sequence
  Detection oligonucleotide for GSTP1
attgttgtgattttgga

SEQ ID NO: 902 - DNA, 16 bp, Artificial Sequence
  Detection oligonucleotide for GSTP1
agtgtgcgtagcgaat

SEQ ID NO: 903 - DNA, 16 bp, Artificial Sequence
  Detection oligonucleotide for GSTP1
gtgtgtagtgaattgg

SEQ ID NO: 904 - DNA, 16 bp, Artificial Sequence
  Detection oligonucleotide for GSTP1
gagtcgtcgcgtagtt

SEQ ID NO: 905 - DNA, 17 bp, Artificial Sequence
  Detection oligonucleotide for GSTP1
ggagttgttgtgtagtt

SEQ ID NO: 906 - DNA, 17 bp, Artificial Sequence
  Detection oligonucleotide for GSTP1
attttcgtcggttttag

SEQ ID NO: 907 - DNA, 18 bp, Artificial Sequence
  Detection oligonucleotide for GSTP1
ggatttttgttggtttta

SEQ ID NO: 908 - DNA, 16 bp, Artificial Sequence
  Detection oligonucleotide for GSTP1
ttcgcggttttcgagt

SEQ ID NO: 909 - DNA, 17 bp, Artificial Sequence
  Detection oligonucleotide for GSTP1
tttgtggtttttgagtt

SEQ ID NO: 910 - DNA, 16 bp, Artificial Sequence
  Detection oligonucleotide for GSTP1
tagcgaagtttcgcgg

SEQ ID NO: 911 - DNA, 16 bp, Artificial Sequence
  Detection oligonucleotide for GSTP1
agtgaagttttgtggt

SEQ ID NO: 912 - DNA, 16 bp, Artificial Sequence
  Detection oligonucleotide for GSTP1
gtcgcgcgtatttatt

SEQ ID NO: 913 - DNA, 17 bp, Artificial Sequence
  Detection oligonucleotide for GSTP1
gggttgtgtgtatttat

SEQ ID NO: 914 - DNA, 20 bp, Artificial Sequence
  Detection oligonucleotide for IGF2
tacgtataaaatttcgtatt

SEQ ID NO: 915 - DNA, 21 bp, Artificial Sequence
  Detection oligonucleotide for IGF2
aaattatgtataaaattttgt

SEQ ID NO: 916 - DNA, 16 bp, Artificial Sequence
  Detection oligonucleotide for IGF2
atagacgcgagttcgg

SEQ ID NO: 917 - DNA, 16 bp, Artificial Sequence
  Detection oligonucleotide for IGF2
agatgtgagtttggtt

SEQ ID NO: 918 - DNA, 16 bp, Artificial Sequence
  Detection oligonucleotide for IGF2
tatcggggtgcgttta

SEQ ID NO: 919 - DNA, 16 bp, Artificial Sequence
  Detection oligonucleotide for IGF2
attggggtgtgtttaa

SEQ ID NO: 920 - DNA, 16 bp, Artificial Sequence
  Detection oligonucleotide for IGF2
ttacggaggtttcggt

SEQ ID NO: 921 - DNA, 16 bp, Artificial Sequence
  Detection oligonucleotide for IGF2
ttatggaggttttggt

SEQ ID NO: 922 - DNA, 17 bp, Artificial Sequence
  Detection oligonucleotide for AR
ttatagtcgtagtcggt

SEQ ID NO: 923 - DNA, 17 bp, Artificial Sequence
  Detection oligonucleotide for AR
agttgtagttggttttg

SEQ ID NO: 924 - DNA, 16 bp, Artificial Sequence
  Detection oligonucleotide for AR
gtcgtggtcgttagta

SEQ ID NO: 925 - DNA, 17 bp, Artificial Sequence
  Detection oligonucleotide for AR
gttgtggttgttagtaa

SEQ ID NO: 926 - DNA, 16 bp, Artificial Sequence
  Detection oligonucleotide for AR
tattttcggacgagga

SEQ ID NO: 927 - DNA, 17 bp, Artificial Sequence
  Detection oligonucleotide for AR
agtatttttggatgagg

SEQ ID NO: 928 - DNA, 10 bp, Artificial Sequence
  chemically treated genomic DNA (Homo sapiens)
gggccgcggc

SEQ ID NO: 929 - DNA, 10 bp, Artificial Sequence
  chemically treated genomic DNA (Homo sapiens)
ccccgcgggg

SEQ ID NO: 930 - DNA, 10 bp, Artificial Sequence
  chemically treated genomic DNA (Homo sapiens)
cgcgggggcg

SEQ ID NO: 931 - DNA, 10 bp, Artificial Sequence
  chemically treated genomic DNA (Homo sapiens)
gcgcgccgcg

SEQ ID NO: 932 - DNA, 10 bp, Artificial Sequence
  chemically treated genomic DNA (Homo sapiens)
gcggggcggc

SEQ ID NO: 933 - DNA, 10 bp, Artificial Sequence
  chemically treated genomic DNA (Homo sapiens)
gcgccgacgt

SEQ ID NO: 934 - DNA, 10 bp, Artificial Sequence
  chemically treated genomic DNA (Homo sapiens)
cgggacgcga

SEQ ID NO: 935 - DNA, 10 bp, Artificial Sequence
  chemically treated genomic DNA (Homo sapiens)
ccgcgatcgc

SEQ ID NO: 936 - DNA, 10 bp, Artificial Sequence
  chemically treated genomic DNA (Homo sapiens)
tggccgccga

SEQ ID NO: 937 - DNA, 10 bp, Artificial Sequence
  chemically treated genomic DNA (Homo sapiens)
tgcgacgccg

SEQ ID NO: 938 - DNA, 10 bp, Artificial Sequence
  chemically treated genomic DNA (Homo sapiens)
atcccgcccg

SEQ ID NO: 939 - DNA, 10 bp, Artificial Sequence
  chemically treated genomic DNA (Homo sapiens)
gcgcatgcgg

SEQ ID NO: 940 - DNA, 10 bp, Artificial Sequence
  chemically treated genomic DNA (Homo sapiens)
gcgacgtgcg

SEQ ID NO: 941 - DNA, 10 bp, Artificial Sequence
  chemically treated genomic DNA (Homo sapiens)
  unsure (7, 9): unknown base
gccgcgngng

SEQ ID NO: 942 - DNA, 10 bp, Artificial Sequence
  chemically treated genomic DNA (Homo sapiens)
  unsure (8, 9): unknown base
gcccgcgnng

SEQ ID NO: 943 - DNA, 10 bp, Artificial Sequence
  chemically treated genomic DNA (Homo sapiens)
agcggccgcg

SEQ ID NO: 944 - DNA, 10 bp, Artificial Sequence
  chemically treated genomic DNA (Homo sapiens)
ctcccacgcg

SEQ ID NO: 945 - DNA, 10 bp, Artificial Sequence
  chemically treated genomic DNA (Homo sapiens)
gaggtgcgcg

SEQ ID NO: 946 - DNA, 10 bp, Artificial Sequence
  chemically treated genomic DNA (Homo sapiens)
aggggacgcg

SEQ ID NO: 947 - DNA, 10 bp, Artificial Sequence
  chemically treated genomic DNA (Homo sapiens)
gagaggcgcg

SEQ ID NO: 948 - DNA, 10 bp, Artificial Sequence
  chemically treated genomic DNA (Homo sapiens)
gcccccgcga

SEQ ID NO: 949 - DNA, 10 bp, Artificial Sequence
  chemically treated genomic DNA (Homo sapiens)
cggggcgcga

SEQ ID NO: 950 - DNA, 10 bp, Artificial Sequence
  chemically treated genomic DNA (Homo sapiens)
ggggacgcga

SEQ ID NO: 951 - DNA, 10 bp, Artificial Sequence
  chemically treated genomic DNA (Homo sapiens)
accccacccg

SEQ ID NO: 952 - DNA, 24 bp, Artificial Sequence
  chemically treated genomic DNA (Homo sapiens)
agcactctccagcctctcaccgac

SEQ ID NO: 953 - DNA, 12 bp, Artificial Sequence
  chemically treated genomic DNA (Homo sapiens)
ccgggtcggtga

SEQ ID NO: 954 - DNA, 24 bp, Artificial Sequence
  chemically treated genomic DNA (Homo sapiens)
accgacgtcgactatccatgaacc

SEQ ID NO: 955 - DNA, 12 bp, Artificial Sequence
  chemically treated genomic DNA (Homo sapiens)
ccggggttcatg

SEQ ID NO: 956 - DNA, 24 bp, Artificial Sequence
  chemically treated genomic DNA (Homo sapiens)
aggcaactgtgctatccgagtgac

SEQ ID NO: 957 - DNA, 12 bp, Artificial Sequence
  chemically treated genomic DNA (Homo sapiens)
ccgggtcactcg

SEQ ID NO: 958 - DNA, 18 bp, Artificial Sequence
  chemically treated genomic DNA (Homo sapiens)
cgcgctactccgcataca

SEQ ID NO: 959 - DNA, 19 bp, Artificial Sequence
  chemically treated genomic DNA (Homo sapiens)
gaggtaatcgaggcggtcg

SEQ ID NO: 960 - DNA, 21 bp, Artificial Sequence
  chemically treated genomic DNA (Homo sapiens)
cgccaattcatacgccgcacc

SEQ ID NO: 961 - DNA, 19 bp, Artificial Sequence
  chemically treated genomic DNA (Homo sapiens)
accgaaaatacgcttcacg

SEQ ID NO: 962 - DNA, 22 bp, Artificial Sequence
  chemically treated genomic DNA (Homo sapiens)
gcgttatcgtaaagtattgcgc

SEQ ID NO: 963 - DNA, 19 bp, Artificial Sequence
  chemically treated genomic DNA (Homo sapiens)
cgcgacgaacaaaacgccg

SEQ ID NO: 964 - DNA, 18 bp, Artificial Sequence
  chemically treated genomic DNA (Homo sapiens)
gcgttttacgtcgtcgcg

SEQ ID NO: 965 - DNA, 18 bp, Artificial Sequence
  chemically treated genomic DNA (Homo sapiens)
gacgctaaacgccaccgt

SEQ ID NO: 966 - DNA, 23 bp, Artificial Sequence
  chemically treated genomic DNA (Homo sapiens)
ccgaccatccgacgccttactcg

SEQ ID NO: 967 - DNA, 25 bp, Artificial Sequence
  chemically treated genomic DNA (Homo sapiens)
cgaatttataccgaacgctcctacg

SEQ ID NO: 968 - DNA, 22 bp, Artificial Sequence
  chemically treated genomic DNA (Homo sapiens)
aggttacgggaggtcgaggtcg

SEQ ID NO: 969 - DNA, 27 bp, Artificial Sequence
  chemically treated genomic DNA (Homo sapiens)
cccgccatcgaccgttcccgaccccta

SEQ ID NO: 970 - DNA, 20 bp, Artificial Sequence
  chemically treated genomic DNA (Homo sapiens)
tcccgaatttataccgaacg

SEQ ID NO: 971 - DNA, 21 bp, Artificial Sequence
  chemically treated genomic DNA (Homo sapiens)
ttttatttaggggtcgggaac

SEQ ID NO: 972 - DNA, 18 bp, Artificial Sequence
  chemically treated genomic DNA (Homo sapiens)
acgccccgccatcgaccg

SEQ ID NO: 973 - DNA, 19 bp, Artificial Sequence
  chemically treated genomic DNA (Homo sapiens)
ttgtggttcgggaagagac

SEQ ID NO: 974 - DNA, 19 bp, Artificial Sequence
  chemically treated genomic DNA (Homo sapiens)
cttcgatcgaaaaaaaccg

SEQ ID NO: 975 - DNA, 20 bp, Artificial Sequence
  chemically treated genomic DNA (Homo sapiens)
aactacgcgcaaacccgcga

SEQ ID NO: 976 - DNA, 21 bp, Artificial Sequence
  chemically treated genomic DNA (Homo sapiens)
cgtttttcgttttattttcgc

SEQ ID NO: 977 - DNA, 18 bp, Artificial Sequence
  chemically treated genomic DNA (Homo sapiens)
gacaaaaaacgccacgtc

SEQ ID NO: 978 - DNA, 22 bp, Artificial Sequence
  chemically treated genomic DNA (Homo sapiens)
ccgacaattcaccgaatcaccg

SEQ ID NO: 979 - DNA, 18 bp, Artificial Sequence
  chemically treated genomic DNA (Homo sapiens)
atctcacctaccgtcgcg

SEQ ID NO: 980 - DNA, 19 bp, Artificial Sequence
  chemically treated genomic DNA (Homo sapiens)
taggagtgcgatcgtttgc

SEQ ID NO: 981 - DNA, 27 bp, Artificial Sequence
  chemically treated genomic DNA (Homo sapiens)
acgaacgttacgaccgatacccaacta

SEQ ID NO: 982 - DNA, 19 bp, Artificial Sequence
  chemically treated genomic DNA (Homo sapiens)
aacgtatcccgacaatccg

SEQ ID NO: 983 - DNA, 29 bp, Artificial Sequence
  chemically treated genomic DNA (Homo sapiens)
gagtatttaaggtttagtgaaacgttagc

SEQ ID NO: 984 - DNA, 29 bp, Artificial Sequence
  chemically treated genomic DNA (Homo sapiens)
caaataacgcgacactaaacgcataattc

SEQ ID NO: 985 - DNA, 18 bp, Artificial Sequence
  chemically treated genomic DNA (Homo sapiens)
tgttttcggagtgcgttc

SEQ ID NO: 986 - DNA, 20 bp, Artificial Sequence
  chemically treated genomic DNA (Homo sapiens)
aaatcaaaccgacgatacga

SEQ ID NO: 987 - DNA, 22 bp, Artificial Sequence
  chemically treated genomic DNA (Homo sapiens)
ccgataaaacgcgtccaaaccg

SEQ ID NO: 988 - DNA, 20 bp, Artificial Sequence
  chemically treated genomic DNA (Homo sapiens)
gggattatttttataaggtt

SEQ ID NO: 989 - DNA, 17 bp, Artificial Sequence
  chemically treated genomic DNA (Homo sapiens)
ctctaaaccccatcccc

SEQ ID NO: 990 - DNA, 24 bp, Artificial Sequence
  chemically treated genomic DNA (Homo sapiens)
cccatccccaaaaacacaaaccac

SEQ ID NO: 991 - DNA, 19 bp, Artificial Sequence
  chemically treated genomic DNA (Homo sapiens)
cgtcgtcgtagttttcgtt

SEQ ID NO: 992 - DNA, 18 bp, Artificial Sequence
  chemically treated genomic DNA (Homo sapiens)
tagtgagtacgcgcggtt

SEQ ID NO: 993 - DNA, 19 bp, Artificial Sequence
  chemically treated genomic DNA (Homo sapiens)
accgaaaatacgcttcacg

SEQ ID NO: 994 - DNA, 22 bp, Artificial Sequence
  chemically treated genomic DNA (Homo sapiens)
gcgttatcgtaaagtattgcgc

SEQ ID NO: 995 - DNA, 19 bp, Artificial Sequence
  chemically treated genomic DNA (Homo sapiens)
cgcgacgaacaaaacgccg

SEQ ID NO: 996 - DNA, 18 bp, Artificial Sequence
  chemically treated genomic DNA (Homo sapiens)
cgcgctactccgcataca

SEQ ID NO: 997 - DNA, 19 bp, Artificial Sequence
  chemically treated genomic DNA (Homo sapiens)
gaggtaatcgaggcggtcg

SEQ ID NO: 998 - DNA, 21 bp, Artificial Sequence
  chemically treated genomic DNA (Homo sapiens)
cgccaattcatacgccgcacc

SEQ ID NO: 999 - DNA, 19 bp, Artificial Sequence
  chemically treated genomic DNA (Homo sapiens)
ttgtggttcgggaagagac

SEQ ID NO: 1000 - DNA, 18 bp, Artificial Sequence
  chemically treated genomic DNA (Homo sapiens)
tcccgaactcttcgatcg

SEQ ID NO: 1001 - DNA, 20 bp, Artificial Sequence
  chemically treated genomic DNA (Homo sapiens)
aactacgcgcaaacccgcga

SEQ ID NO: 1002 - DNA, 18 bp, Artificial Sequence
  chemically treated genomic DNA (Homo sapiens)
cgcgctactccgcataca

SEQ ID NO: 1003 - DNA, 19 bp, Artificial Sequence
  chemically treated genomic DNA (Homo sapiens)
gaggtaatcgaggcggtcg

SEQ ID NO: 1004 - DNA, 21 bp, Artificial Sequence
  chemically treated genomic DNA (Homo sapiens)
cgccaattcatacgccgcacc

SEQ ID NO: 1005 - DNA, 19 bp, Artificial Sequence
  chemically treated genomic DNA (Homo sapiens)
accgaaaatacgcttcacg

SEQ ID NO: 1006 - DNA, 22 bp, Artificial Sequence
  chemically treated genomic DNA (Homo sapiens)
gcgttatcgtaaagtattgcgc

SEQ ID NO: 1007 - DNA, 19 bp, Artificial Sequence
  chemically treated genomic DNA (Homo sapiens)
cgcgacgaacaaaacgccg

SEQ ID NO: 1008 - DNA, 18 bp, Artificial Sequence
  chemically treated genomic DNA (Homo sapiens)
gcgttttacgtcgtcgcg

SEQ ID NO: 1009 - DNA, 18 bp, Artificial Sequence
  chemically treated genomic DNA (Homo sapiens)
gacgctaaacgccaccgt

SEQ ID NO: 1010 - DNA, 23 bp, Artificial Sequence
  chemically treated genomic DNA (Homo sapiens)
ccgaccatccgacgccttactcg

SEQ ID NO: 1011 - DNA, 21 bp, Artificial Sequence
  chemically treated genomic DNA (Homo sapiens)
cgtttttcgttttattttcgc

SEQ ID NO: 1012 - DNA, 18 bp, Artificial Sequence
  chemically treated genomic DNA (Homo sapiens)
gacaaaaaacgccacgtc

SEQ ID NO: 1013 - DNA, 22 bp, Artificial Sequence
  chemically treated genomic DNA (Homo sapiens)
ccgacaattcaccgaatcaccg

SEQ ID NO: 1014 - DNA, 18 bp, Artificial Sequence
  chemically treated genomic DNA (Homo sapiens)
atctcacctaccgtcgcg

SEQ ID NO: 1015 - DNA, 19 bp, Artificial Sequence
  chemically treated genomic DNA (Homo sapiens)
taggagtgcgatcgtttgc

SEQ ID NO: 1016 - DNA, 27 bp, Artificial Sequence
  chemically treated genomic DNA (Homo sapiens)
acgaacgttacgaccgatacccaacta

SEQ ID NO: 1017 - DNA, 6308 bp, Homo Sapiens
ccatgaagagcacccacctgctacactatttagaaccagctggcacaaggggccacctttgaagataggcaaactctctcccttctgcccaaaattcaagaaatgttgtggtgaagagagacagtggagacagaaatgaaattaaatctgatgggcctgggttcaaatccagttcaaccacttactagctgtgtgactttggcaaacttatttcccttctctgagctccaggctagtgagtaaccagcagggctataaggtccgtgacgcttaaagtagtttggctaagaacctgctgattttctcctccacttttctgtctccacgtagtattcccttatccactcaacaaataaatacccatgtctggcatagtatgctgaatagatagttccttccctagaggaagtgacaaaagtgatctctttcagatggaaaaactgaggcccagaagttaagtggcctgcaagagccctgagatatttggacttccttgccactagctagaagagcttctcactgaacttttgtttagttatatcccacccttacggctcacctaagatcctgggagccttccccgggaacttccccggggtctcacctcaagcgagggcccaggaagggtgaaccaagtcgtctggatttatggattcaacaggtgtggggcggaaggccttttcctgccgagggtgcggcccagcgccaccccgctcagtctcagcgggacacctccacagccagtaggaagggcagttcaaaattcagtgctacccccgcgtcccagctaagaaaacaagggccatccaggtgccctcccagctgacgagatggaaaaatcaaagtataatagataaagagggaccgtttcaaaagaaaaaggggacttgaaaatattgtagactagggggaggaaaggaggtggaaagaaacaatgccctacacacaggaggggctccacaaacaatttgttgaaaagaaatcgctctgcggacgctacaaagatgccctgcaggacaagcccacttacacagaaaaaaagaaatcctatctagggagttgttggtccccagagtccccatccctcattccccaaccccgtggcgtgcgcgcttcccgctagacttcagcctggggctctttcctggcccccagatcccccgcccctccggttgcgctccccgcctggccccgagggtaaacctgcctccgcggaacacatctccgcgagactgggccaaagctttggggcctgcactcctcgcaaaggagagcctccgagaccggaggttcatctcaacccccgcgttcgagcccgggcctggagaaaagtgccctcccctcggcctcggcctcgtcaccgcgggggactggcgggaggagtaggggaggccggtgggacacctcgcaccaggccgcccacctacaggggcgtccgggctaggggagcagacggagagcgggggcggctcctgactcctccgcgcgccggggccggggccgggccgggggctcggcccgctcagccaatgggcgccgcgctcgggccccctcccccgcaccgggaggggccgaggctgggctgctgctgccgaggtcgtgtgcgacgtgccgctcccgggccctgtgtccccagccccagcagggccgcgtggacggcgcggcgcccccggaaggaggccatgtgctcagtgccggcgccaactacgcacgcggcgccctccggcccgctagatccgaagcccatccccactgcggccagcggcccggcggggcgctgcgctcgggacccgcaccgagccaggctcggagaggcgcgcggcccgccccgggcgcacagcgcagcggggcggcgggggaggccctggccggcgtaaggcgggcaggagtctgcgcctttgttcctggcgggagggcccgcgggcgcgcgactcaccttgctgctgggctccatggcagcgctgcgctggtggctctggctgcgccgggtacgcgggtggcgacgggcgtgcgagcggcgctctcccgctcaggctcgtgctccggtccggggactcccactgcgactctgactccgacccccgtcgtttggtctcctgctccctggcgtgctcactcggggacccgcgactagcgaccggcacgctcgctgttgctacctcttgcctcttgccagagagcgcgcggaccgtagcgtttataggaccccggccattggctggcgacgccggtgtgtcaggggtgtgtgggcaggacctcggggcggggcctggggcccagcctgtcctgggcggcgctctgcggggagggggtgaggggagtggccggggccggggccccccctaaccactgcctcgctcaggctgccgatcggctcgttctctctgcgttgggaccgcggagggcattcgctgtgtgactcagggcaagtgtgcgcacctctctgagcctccgcggccttctctagcaaaatggtggagccggtacccggctgtaaggcaagctgggatgcgcggagtagcgggtggaaagctggactggagttctcactcggccgctgggtgacttcggtgcactagggatagtaacagtaccacctcgtagggttgtagaaagaccaagtgagttaatatttgtaaagtgtttagaacagcgtctactgcatggaaagtagtatttatttgttagagagactccaggaggtcttgcccagggattgacttctcccttccctgtctccaccccccacattcccgtttgtgagccaagccttgcttttgcaccggccgggctctcttgcctggaaatgcatacccatctcaaacctgggctttaaaatcacctcctctgggacgccttcctctacttctcacagttcaggtgagtctatggtgacctgtaagtgtggaaaatatgaaaggcaggctaactgactgacatgataggacattaaggacatgatagacctcgggtttgaaccagctcaactgtatactggcccggccgcgatcctgggcgagttcctggccagtgaggctgttttcgtttttttctttaatttttttttttctcagacagagtctcgctctgtcgcccaggctggagtgcagcggcacgatctcggctcactgtaacctccgcctcccggattcaagcagttctctgcctcagcctcccgagtagctgggattacaggcgcccgctatcacccctggctaattatttttatttttagtagagacggggtttcaccattttggccaggctggtcttgaactcttgacctcgtgatccacccacctcgcctcccaaagtactgggattacaggcgtgagccactgagcccggccgaggctgtcttcttatgagtaaatggaattcccacaccaatctcattgctatcaggagaggtgcaatttccagataagctcatgaagtgtttagcatggaagttctcatttactggttggtggtattgttggtttatttatttagtctgttagtaaataaataaatgctggtctcaaactcctgggctcaagtgatcctcccaccttagcctccgtagtagctgggagtgcaggcatgtgccactgcactggtagtggtattgctatcatctgacttcaccttatttcctctagaccagtgccttacttgagacacagtgaagggaaggacccccagtccaaaggtctgatcaaagtcttgagggtccctttcccgatggagggagtcatggtgggcttactgtctgtcggaaaccgggaggctgagccgaccagatgacccctggagttctctggcaatgtgtccagttctggctgaggggcaccttggttgagtatggagccctgaaacagaaggcaggtgcattctgggcacccccctgcccaaggcttcaattcctgtggtctctctatgctcagcctggaaagcttgggccacctctctcctcacccctggacagaccaagtcctgctgactccgctgtctacaccacctcatcctccttccctcccctgctgtctgcagggcctccatctcctctggtcttttgtcctccagtcctgcaccctgccactctcctgctcatctgtctgaaattgtcatggagggagtaagggccaagcctggccatcacggtccttcttcatggcaccagtttacacgctcagcctcgcccctcacaccagcaactcacatccacacatttgctcagcttgtctcctctgcctgggaagccctccccgacctcaccatgccaaaaagcaccatgggtccttcctcctccgggaagtgtccctggttctcccaagtggaaatctttctctcctttaccatttggtgttttgtaggttgccacttgtcctctgtctgccttccctcagcctgtgagcaccttgaggacaggttctgcagctgaggcacgtgggtgaatgactgaaggagggaaggaatgcacgaatgagtgagcagctaatctacctgtgttgaatgttccttcccctccagtccgtcctgctgatacttccagtctttccttaagtaccttttgggttttgctacttccctcctcaaagtctctccacagctccttgtttcttagcacatccagtctatgccttttcccagttgcgggtctgccttactcagcccatgggtcacactcaccaaacagccaccttgtccttctctgggccagccccatgctggccactttcccagggacagagacatgtgaccccattgttagcctcatggaggccccaagctggaggaggagcaagaggggaaatgagcagcaacaataccaagtcaagcgtagagggttaagaatctgtacaggtgcagaacttgtaccacaggggaaggagagtgagtagagagagcatctgggaagggggaggtcatgctaagcagggtttggaagactgaataggagttcaccagatggattgagggaaggccattctcagcagagagaagagcatgtgcaaaggcagcagactgccagaatgattacctagggaacgtgagaatctctgggccactcttagagattcatgatggagccccagatccggactctttgagtcccagctctgctatttacttgcaaacattcatgggcaaacaatgccttctcttctctgagcctgaagacccacatctgtaaaatagatataacaaacccttcctgggtaggcctgagggaaagtggatgtttataaaggcttagctatgtaaactgtactcattcttgacgtgagaagttcagtcaaatccccatcccatggtagggcggtgcttgaggaaaaagcacagtggccaaaaaaaagcttttccttcacccaccccaccccacctgcccacacacagacccccattaccttctctgtgttcctctctgtgaatgttttatgacccctggaggctactggtcagaagcaaattcatcagaagctattgacgctgcatcacagactagattctcaggtggactggtttgttatttgggtggctgattccttggaagcagaatttaactccaactagggaatgagccctagagaaggccccaggaaatagcacatgagcagagaaggtttgggtgcaaggggaaaggggagcaggaggggcacctaagtagcccctgtggctggggcatgggggcttagggaggagaagagactgaagaagtggaatcacagaggctcccaaatgccaggtataggagttagggctttatgcagtgggtagtggcgagccatggagagttattgagcagggaaaggacctgaggaaacctcagtgtccccacaagcctactctacctgaggcactaaagggggtgtgaggaggctgtggaaccccagcattcagcttgaacgacctagtgccccttccctagtctgcgcccacactgacagctttattccctggaggctgcctttagtcctggacggaactcggcctcttctgggtccgattctaagcagttccagccccagctagtctggaggaaaagagctctctgggactggctagcagggaggtgtcaggtgccaggcggatgctggagcctagtgtgtgcctcagagcacgcaagtgggtgggggaggggtggtggtggtgatggtggtggtggcagggccgtgcagggcgggtcctagcagctccagagttaggagtgagtaaggcgggctgggaaaagactctgttgcctttaaaggcaagcgtccctggcagccaggaggaaaggttttgctgagtcagctacaattggtacaagaggggatagcagg

SEQ ID NO: 1018 - DNA, 6329 bp, Homo Sapiens
tatctgactgtgtctgctggcattcccttcaagggtacagagctggggttcttgatctgattcctatgcatggacctccaggtggtatcagaggagtcatggagtcagcaaagttcctaagagcccatgcaaaattttatctctgtgcacagggtcctgatcctcaggggttgtgaatcaaggaaagctaaaaaccactggtttagtgctacatacaaaacaggaatctactgaaggtgcccgtgacacctgtcatttgaggtgcagaacaaagggtgccatctattcaaagcaaaagtaaaatatgggctgggcgcggtggttcatgcctgtaatcccagcagtttgggaggccgaggctggtggatcacctggggttaggagttcgagtacagcctggccaacatgatgaaaccccgtttgtactaaaaatacaaaaattagccgggcgtgatggcgcgcgcctgtaatcccagctactcaggtggctgaggcaggggaatcacttaaacccgggaggcggaggttgcagtgagccgagatggcgccattgcactccagcctgggcaacaagagcgaaactccatacccgcaccccccacccaccaaaaaaaaaaaagaaaagaacaaaagaaaatgtgatatgatggtcagaagctgtagtcactaagggtcagatcgtccattccctttatcccctagtccagataaaccaaaggagactcaagagagactctgcccaagaccacaaatcacagagctactaagtggcaaagctgagcatcaaagttcactggatttccaccaggatgtcagggcatgaaattatgtttatacttttttagaatgggtttgaccaaaatccccccaattcttgtaaatatcccactccattaagaaggtagccttccaaaattttattgtattttttttgagacggagtcttgctctgttacccaggctggagtgcagtggtgtgatctcggctcaccgcaacctccatctcccaggttcaagcaattctcctgcctcagcctcgctagtagctgggactacaggcgtgtgccaccacacctgcctaatttttgtattttttagtagagacggggttttgccatgttggccaggctggtctcgaactcctaacctcaggtgatccgcccacctccgcctcccaaagtgctgggattacaggcgtgagccaccacgcccggtctagccttccaaaattttaaaatcaagcttccatatagaatttgatacatttaaatactccccaaatcatcaatcaagtcacggatctttcacaaaagtcgcatacagattttttattttattttttttttgagacggagtctcgcactgtcgcccagtctggagtgcagtggcacgatcttggctcactgaagcctccacctccctggttcaagagattctcctgcctcagcctgttgagtagctgggactataggcatgcgccatcacgcccggctaatttttgtatttttagtaaagactgggtttcaccatattggtcagtctggtcttgaactcttgacctcatgatccacccgcctcagcctcccaaagtgctgggattataggagtgagccaccacgcgcagcccagcatacagatttatgaggtgaaccttagaggctcattatcccctatcctatgttatgaacacaactttaagaagcaacacaggggccaggctcacacttgtaatcccagcaccttgggcggccgaggcgaacacgaggccgatcacgaggtcaggagttcgagaccggcctggccaacacagtgaaaccccatctctactaaaaatacaaaaattagctggacatggtgatgggcgcctataatcccagctactcgggaggctgaagcaggagaatcgcttgaaccggggaggcggaggctgcagtgagccaagattgcgccactgcactccagcctgagtgacagaggtagactccgtctgaaaaaaaaaaacgcagcacaggtcacaagctcattgagtgaggcacttctaaatgtatcagggaagacagccactgacagctgacttcggggtggatttgtacaatttcaatctgcaagctgcaggacctttctaagtctccctctcatgttaatatcaatagcgttgcctaaacattaaatgctttttcttcaacccaggtaatggggtcattcataaattaaactgagaacaacctttccagtcccatgttcacaaacactacatgtagtagaaccaaagatactaggcaattattctgagatcagattaaaaaataattactgtcataaaaaagttacagaatcatttgttccaatgccaaactctgcctcagcatatgaaatttaaagtaaccaaaaacttagtctcacctgggaagggaaatcaaagtgacatttgaacccaagttcaatgacaacacgtccttcaatttcaaagcgagcgcattgctttattcattcaaagagttttaacggcacaatatcccatagcatacacaaaatctcctaaggcgtacattatggtaaagtttctgactgcttgtgaactatatttagccctttctgccagctctctccgtagtctcccacccccaaaaggtataactggaataggcctcagggagcacctgtggcctgaaaaggctgtgaccaatcctcagagctttaccggctgcaatctacaagtaggctcgaccattctattttggatcaaggagactctgccaacccccaagtgaccgcaagtggacaagatcaatttgggagaaaacgctgtgagggttttttcgccaagccagcagcccccaccgccacactccgaaaagggtgaagatttggttaccatccaggcggcgaaagaatacggccgggctgtctgggggctcacgactgcctgtcggccggcgatcccgcagcctgggccgggctgtggtgtcgggagcacgcgaagaggcagggatccccggggcatgcggagagggaaccagaacgaggttaggagcctgcaggtgtcgcccagggaggggacgaggtcgcccagggctggcacggccgagtgagaccgagagtgtggctctggactcggacagaccggtcacactctcgggttgtgaccttgagcacacgacttgaccgctgtgcgccttagtttcctcctctctaaaatgggggtcgttcaagcggaaaacgcgcctcggagcgcttggcacggcgcctggcgcatagtaagcgctccctccatgtgagcgctctggctcctttcgccgccgggaggaactggggaagccccgcgcggggagtccccgggaggcggatccgaggctggggcaagggaaccgggtcggggactcaccgagcacgtccgcggaacggtgccgggccacgaagcacgcgtcgtccccgtagcacgcgcccttcttgaggaggcccttacggaagtccttcccgaagccgcagccggccgtcaccagtccgtagtcgccgccgccgccgccgccggccctggggtcggtctgcgagaggccgccgagcacggcgcgggccaccagccgcccgtacgagaggaccgagaacatcgccgccgccgcccccccgaggaggcggggggccgggggagcaggaggacgcggaggcccggagccggctctctcctcagccgcagtcgcgccgccgctggggcgctcctcagggcggcgcgcagtggccgccgccgcccctgcccgacgcgcggggcctcgcacgcgctcagccgcgcgcaccggagccagagcgaggtcagaagcggcggctcctccgcctcagcccaactgaagtcccggctgcagcggccgccgccgccgccgccatcttccgctccactagcgtgttccgggcggtgccggcagcaccgccccctccctggccctgcccctagccccgccccgattcaccgctcaggcccaagcccagccccttgggctcgctgccttatgcagtcaccaaggttgaacatgcgcagagggtgcggacgcagtgtctcttgggaattatagtcccggagtcgtagtcacttttgacttggctgccaaagatttaggacctagggggattcctcagacgcgggacctatgttaagttagtaggaattgcaggtgggccacgtgagggttttctaccctgttttaaccgtatcttttaaagcctgttttaaataaataacgccaccattcctttaaacaaaaacctgcaagaaaccagaatggagtcacataatgagaaacagaggtacacagatctagtgacacctccccaagtaatatactggaaggatttagggcggcaaactgtttggaaagaagagactttttgtagtcttttaggaaaaattgagaaaatgttatgtgtccctatcagagtgggaggggacacagatggtgtcatgtcccttttgctaactggcctctagccatgctcacagctgtctcaagacctttgcccttgctttcgcttctaccctttggaatgtaattcgtttacctgagggtcctgtgttttctgttgctgtatccccagaacacgtgagcacccagtaaatatgtgaatgaatgaaagaatgaatgaatatttcactagattctaagtttcccaaggacaaggatcatttgctgctcaattattagaatctaaagcaatgcctggcacacagtaggagagtgtgtaaatgtctgtggaataaaagaaggaataatgggctgggcgtggtggctcacacctgtaatcccagcactttggaaggccgaggtgggcagatcacttgaggtcaggagttcaacaccagcctggccaacatggtctctactgaaaatacaaaaaaaaattagctgggcttggtgacaaacgattgtaatgccagctactcaggaggctgagacaggagaatcgcttgaacctgggaggcagaggttgcagtgagccgagacagcgccactgcattccagcctgggagacagagctggactccatctcaaaaaaaaaaaaaggaaggagtaatggaataagaacacaaatgataaaagaaagtcatgtttgttgaatacaggaatgattgagtgaatggggttcacaaacaacagaaaatgagctttggggcaagtaattcaatttagagtaatttttagtttgattgaaacatatatttctcagaaacagcagtctttttctagttcacttttaacaagaccattgttactttggggattcccacctcgtttttaaatggtccttttttatgctttcttaatatatttaaaatgctgccaactatcaactcaacacatattattccgttatcctaattactgtcatcattaaacacttttgcagttcacagtgtgccaagtactgtctatatatatgtttctgtctttaagagctttcatcaaaattggacggaagaaatgacttcacgtagtggcattttgtcaaatatacagaacccagaaaatgttcatttactggataaatggtatagtaatgacaataatgcattcacaccttccttttttttaatggcacaagaattggagagtgcccagaagagggggtagtgcctctcggaatcctctacttggcatttatattgctgccagctgtgctaaaggtagctctttcaagtacacataccactaccagatcccagtcagtctggcaggtaattctaccccaaggacaaactttttaaaatagcatgtcaaccctatttcttgcctcgtcaaactccttcagactgctcctacttttccttttcagggcatatattacctaatttccatgtcagtcacaagaactggtttgatgggatgagtaggaacctaaaatgtgactctaaagccagtaacttctgctccgatggggctgctgttttcatgattaagtgataccagtgccttgagtttccggcaaatgaatttcctgcaagtgagtttcctgcaaatgagttgcccacagaagcacgtggcgaacagaatccttctcaaagctcctttgcaagttttaaaggaacaggagatagggcctcgggttctcttgaatcatttattccagagccagctctgaagtttcatcaccatgggggaagccaggagagggtactttacaaaacacctcccttcccgttccttctcccaggaacacaattcacgtttgacattttgttggacttaaaaaggcctggattttcttccttaacagagttacattcctagcacttcagggattcctgagaggtcagttgccactcttaaaggtgaacaagtgtg

SEQ ID NO: 1019 - DNA, 6288 bp, Homo Sapiens
tttgagcaagagtttaaaagaactgacagactgataaaaagcttcaagtagtccagaggactgagtactaaaactcagaacaatgtaacaaaagcacagaagacaaagttaaaatgctttacatgacagtagaacatttaggctaagctggaggactggggagaacaagtgaagaaggtaagttttggctagataataggtggcctttagtgtcaggatgaggatttggaagttaatcttttggtcagtggataataaatgatggcatttgtgtagttgagccagttgacaatgctttaacaacttcaaaaggccctgaaaaacatggtccctaatccttaagaaaaaaggaactcctgacttcaggaccctaagctaggaggaaattggataaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaaaaaaatcatgtataccgcattttatatcttttaattgggtgtaaatttgaatttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactaccgcaaaacgggctggttatgcgctacttatagagcccgtatgcaaatgaagactcgcaaagtgctgcgctttcattggttaacttacaacggtgtcgtcagagggggtggagtctatgtaaataatagattctagtcttgcttccttaatggtcactgtaacaaaagtcttgttatcctatcagaatggtccatttcacactaaccagttttaagctaggtgaagcgatagtttctacggcttggggttttttcttggttttcactttccattagacttgcatacggaagaaatcttaacgccagctagacaagttaactctcttgcctcgtttttgcatttttattctatactttgtggaaatttttttctcttccttgaaatactacctcacccatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaacgctcggccggaaccacaaggaccatgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatatgccttaggcccgctccccgcggatgcggcgggccaactggatgtccttgggcatgatggtcacgcgcttggcatggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtagacttctggtagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgataggagagggtctaggcagtcatatttatagacatagtctcctcttgattgggcctgaaaaggaaattttcaaacttgtgatctcattggttaaaattcaatcctctttactggggcggaagattgttctgctaatctttcttcccttattatttccccctttcctgatttttttctgtaattttatcgatcacggattgtttttgaagactttcctttaaattagtctaacttttgtaaaagcaatgtataaagtgttttgcatcccattttaacagagattttttttttccccgaattcaagcatgcccttctatgagctatcagcctgtttcaggttacctgttactgtagctcttctaccatagctaacatttatttcatgtctggcattttgctcagcaagttagatgcattgtataccatgaatgaccgaagcttagcaaaaaaatatgtaattgaaggaatgaaaaaattgatcttatttacttgaccttggaacccagccaaagccatttcatgtgggtagtgtgctgacctatattgacctgatattagagcctctgccttcctttagtcttttctccctgcgatgtggttccttcttcctcaacctcacatcaatggccaattaggtcctgcagatgttaagcttctaaatcaaagaaggacaacaccagaaattcatttctcctttacaatgtagaatagtttgtaaattagtgcttattagccagattacaagttcaagtttcaaagcaaattattcatcaattgctgacttgctaacattttattcaataaagtattttataatgcttaaaagtttagttttttttctgttctctatgaagagagtaaagatgctttgctttttcaatttcatgtgctttgaagtatgtattgttcagaacagtaaatatcatagtggttatgtagaagcaactgatacttaaaagttgtagtagttaatataaaacttttaatcatatccttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatgttactcttctcactttacagataagaaaactgagtctcagagaaattatggcttgtcctgggtaagtaacaaagcctgtgtaatattctaaagcaaaagaatgaaactgtaatgatgaaactttctatttcattaggcttagaggatacctttttttttttttttcatttgagatggagtctcactctgtcacccaggctggagtgcagtggtaggatctctgctcactgcagcctctgcctcctgtgttcaagcaattctcctgtctcagcctcctgagcagctgggactataggcgcaagccaccacccccagctaatttatttatttatttgtatttttagtagagacacggtttcaccatattggtcaggctggtctcgaactcctgacctcaggtgatccaccctcctcggcctcccaaagtgcttgggttgcaggcatgagccccacgcacccagccaacacagtttaaagcacaaaagcgttttcccatcaagcaatcacatcatctagtatttctcaaacatctacacccaactattcccattagaagggaaaactaccccatggaatctggatgatagcccaaagcagcccacccaagcatcacatttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcaactttatggtgcaaaagaagctctgcttttcttcagttgtaacaaagacggaatattcctcctaaaatttttgaagtgtccttcagcagaaattataaggctgtgcagcttgaata

SEQ ID NO: 1020 - DNA, 6502 bp, Homo Sapiens
ccaaaataacaaaattttatcacattttgtgtatactttcagctaccacaagaccattccctctgtgtgtatgtataatcaaatcgattttttctcacttaatataccaaagtacatcttcccatgtcaacatacatccatatctattgccaccttcagaagttacatataatttcatcctatggatgcactgaaatttatttataaaatcctttatttgccctctccttaatacattgctattggaaacagtgctgagaaaaacgaattgtatgcatctctaattattttctgaaaatattttagtataatggaatcaatgggtaaaggatacatacctttttaagagtgatgttcaccaccaaattgtttatttaaaaagttaacagcaacttaaactttaagcagtggtgtaagtactactgattttccagatcactagtagatttggaaaaagtactttgaccaattttaaattatagttcttatttctttaaaaaaaattctctgtaaaaggaagacacatttttcattgcaaataataaatgtctatatttatgtatataatgtgaatattttgcaagtatgttgtcttttattttgttaacttttttctgatgtaaggggagttttaatttttgttttctaaatcaacctgcagaatgcattcataggaaggtctttgtcaacataaaaatgtatctgtataaataggcattcgtgttttcttctggcattttctaattttgtatatttaagtttttacgcatattctatcaataacttatttttgtaacataaaaatctagctagttttctcgagttcacagacatgtcatttacaaataactcatctttccatacacatatgaaatgtcatcaggatcaggttctaaaatcttacacatttttcagtatgtgtgcattttttattctgttccacacatttatctgtcttctcatcttttagtaaatgaaacctaatatcacactttgatatatagaagggcaagtctttactctgttataaaaattttcttaatgtcatcataagagtaaaaggtagcatacgtaacctagaaatcttaaaaccttgatgcttttatttggtttatctaaaatgaatagagttcacatctcgagaaaaatgagtcttcccacatgcacacgtatgttgactgcggcattattcacaattacaaagacttggaaccaacccaaatgtccataatgatagactggattaagaaaatgtggcacatatacaccacggaatactatgcagccataaaaaaggatgagttcatgtcctttgcagggacatggatgaagctggaaaccatcattctcagcaaactatcacaagatcagaaaaccaaacaccacatgttctcactcgtaagtgggagttgaacaatgagaacacatggacacagggaggggaacatcacacaccagggcctgtcggggggagggggtggggggccaggggagggataacattaggagaaatacctaatgtaggtgacgggttgaggggtgcagcaaaccaccacggcacgtgtatacctatgtaacaaaactgcacgtcctgcgcatgtaatccagaacttaaagtataatttaaaaaaaaaaagaagaaaaaaagaaagaaaaatgagtcttcctattcaagaacagggaaccatcctctcacttcaaaagatccttctgaggtcattcatgaaataacttattactcaggtgtaggtggatataaaagggatattagattttatccaaagaatttttagcccagaagttaatataatatagaaattatttttctcatgatgcttgtttccataacatatataacattgtttaaaatgtgtacaataaaaataaaaagctatgtttcttaattttttttaaagcactaaaactttcagtaaagtaacgggaattatgagaggatcggaccagctaaagttttgtttgtcgcgctgctcatattgatgaccttgaggttgccacaccggctgctgcgggctgcagagggaacaaagcccagcgccctcggggacaggggtgagccgagagcaggaaagggggcctctccccgacccgccctcctccctcctctgccgggctccagttcctattacctgttcttctcgtctctgtcatccacgccactcttcggcagagaaaggatccgccgcatcgtctctgtccggtgtcggccggcagctctgcggagcctgtcgaaccccttgtccgggtcgtggcgcctgggctgggaggaggcgtggtcctcactctcactcccggcgcccgcgcccaccttcccggggctgctgaccgagccccagggcagctcgcccttccccctcctgaagcccgaggtcttcttcatggctccgtctaccggcttcggagacccgctggactttccgccgcctccggaaccctatatgaggaagcaaatcgcgtccgccacagcctccaaccaggaaactccgcgactctcagcccctcagaagagaaacggagacgcgccaagcaaagccgttacacggactgtgcacgcgcctccggtgtccctgcgcgtgacacaaatttggccccgagggagctccgtgtgctcagcctcagagccgtaggcgagagcgcctgtctgcatgagtgagcatatgggtgtttttgagtctgtgggtgtcacagagaggagatcgggagctgcctgctcacaggcactttgggaccccgaaagaaaaggctgtgccgagagagttcttccagtcagaggtttgggaatgggggagaagggagtgcccggaatcccgacctcagaactgagcctccgaagtgggaaacagtggctcccccacacgctcaagggccaggcaggtgcatccaccctgccttgcatggcccaggtgtgagccggtgggcagaggggtggccctgggtccagctgagaaggctcccgggattgacaggggttggggttggggagttctgccttcctgcgtggcccagtgctgggaggggtaagggatgagggcaggggtcctatcgctgggctctgacccctcaggccactcagaccctgcccatgtgggcactcaggggtcaggtgttcttagagggaactaagctgggcagggtcaccgtccccttctgcagaggaggaagctgaggcccacgaggtaaacagtgggctgggagtgggcctggtagaccccaatcccagcccatggagaccaactactgagggagcactacaaacgccccttaacggctggatcccccagttttcatgcaatggggtctacactgaccctggggtctcactgggagagagcaggaggtggcttgaggctgggcatgggtggccacgggggcatggactggctgacccctgtgcattgaccacactctccatcccccaggtgtcatgaagactggacatgggcctatcagggccatgggcatgatgtcagccaaggaactcgcggcctgcctctgccaagagaccagcatctcggcctgagcactcccagcctcccatcgccttcaacctggctgcattcagctgccatgcccctacctccttgtgtggtcagcaccctccaggacttcatcttgggtcacccaaaggccgaggacattgctggccagcaggaaattcatggtgcatccaggaagacttccaagaggtggtggagcagggggcgccacacccagacagctgtgtgtaattgcgcagctgcgggctgctgcgggtgctggccggcagtgcattctgggcacactggactgtgtcaccgcatgcaggctgtggccggagggggaactgctggccgccaaggcctatgtgcctggaaaccagcagggctgctgcaggaggagggctgcagaatgctccagctcagacctgactcagggttttagagggcatagggcataaggctgtggacatagacagccctactgcgcaggaagagcataaaccagccggagggcatgcatgtgggctgctgttagattctgttctcctttgaggtagggaaggatgtgtttctattttatggatgagcaaactgaggcagagtgctggagtgatttcccccagcaacgatggcagatttagctccagggcttagattttaggatcctccctctcaaataccatgatgtatcatgggctttctctccacagaaaattagaaactcagaaatggaaagggaacaatgaaacttacccattctcccactgctcacatttccttctggtttttttgcgtgtgcatataaaatatatctcagaaaattgagtttgtgctgtggatgccatttatatcctaccttttatactcaatagatcatgaaaatcccctttgttgctaattatatttcctggcagccccatggcccatcctatgcacgtgctgttattccttcggagagtcctagatttttgctcttagttgtaacacatcaggagtgacatcctgtctccacgatgttttctccttaagatggagacagatatagcgctcctggatcagagagcactgccacctgtaggatccttgacttcaggagctgtccccctaaccatctggtcacctctcatcctccacccagctctgatgctcactgcaaattgtttgccaacctaacgggtgaaccctcagctgttctgatgagtactcctctgactgctggaaggtgacaggaaggagttttagcaacattaaaaccactgagactggggatttgggggcatcattaatgtcagccccctccccaccaagtgcgcgcacacacacacacacacacacacacacacacactcttattctgcctcccaggtgcttaatttgtatggctttggtttgctagtgaggaagaactttcttctttcttttatgtgatttgaggccattatatttgtatctggaaattgttaaaattgaggctctgtctccttttcccagtgagaattcatgagcattcccaacattcccacgtggacacagacacatgccacttgtagcccctgtgttaccttgttctgcctacagacacacccatgggtccagagaccagcaaggccatattgctaatccaaatttttgtggaaaaggaaactgatgcaggatctgcccagggtcagccctgctgttgagcatctgtgtaacctcaattctgtcatctgtaaagtgcctccctgacagggcaatggagagattgaggggaatgtagggtcgatggctgcacaccgggaagtgcagctgtgggttctggggatggcatggcgtgggggtccctccaaagggacacaggtctctgcagtcctgtgggaaggaagctacccaggccaggtgcatagggacaggatttaccttggcccaatcatctgggtagttgaggggttgtggggaaggggccagcccatcctgagcaactctccccacagggaagccccacggcatgcaccagctggccacactgccaatgagttggatgtggaggacgtatcgcaccttctggtggccaacaccctggtggccacctggatgaggcccacaagtccctgctggtagccctctcctgaggactcagatggccccgtgctggccctgctggccttgctgcggctggggagaggctgcttctacgatgccaacccaggtgggctgcagagggcaggtagcagcgggactcttctctgaggagggcacaggccttccgtggcccttgctctccaccccacaacctgggctttggagcaagcaaaccttgttcagccctagttctgccacctgccacaggccctcacctctttgaccttcagtctcctcatctgtgtcctggtcttttaggttgtcatggaaattagccgaagcaggtaccccagggcccagcaggtttcctgcatacggtaagtgctttgtatttgtttttgctgtggttccgatgatatcggtgaaggtttttgtttgtgtgtttttgtccctatgcccttccataccatactgcttttcaggtgaaaagaggccatgtattttacatgttctacattacaagaaaactcagaagaattctttttacaaaaggcccaattcaattgtatgaaaagcatctaagaagacagtataaattattgtgacagtataattaaaactggaaagaagtcctcacattaagagttattcctatatatcacaatgctatagatagtgatactgtttctctgtacaaaaagtatgaggcaaaagctcatgcagagcccttgactttcccgcctctaagctagaacatctccagctccttcgctcgtgatgtgccgactctcagaaactcattctgatcctgtgcactttgtactcttcaagaagaaagtgccaattgaaaattgtatggccatcagtgagtttcaaataataacagatgagaattctcctgatatgcctattaaaatagaattagagtatgttctcactatctt

SEQ ID NO: 1021 - DNA, 6173 bp, Homo Sapiens
agtggagatgggtttcatcatgttggccaggttggtttcgaacacctgacctcaagtgatccacccacctcagcctcccaaagtgctgggattaaaggtgtgagccaccgcacctggcctcccgatctcttttctttgtttttaaatagagaagggggtctcactatgttgcccaggtcagtcttgagctccttgccacaagtgatcctcctgcctggacctcccacatgccagcccagacattttttataattctgttcaagttcagttatacggcttcctcagtttcaaggaggaatgaaatattacttggaaataatttgcttgatgcttatatcattgaatataacactataattctaatttagctcctcaaaccctttctggaaccgtcttgattgatcagggctgtgcctcatcaaattctgcacatttgttactatttgacagttatttccattattttcagttgtgtgtaaaattgttttaaggaagtctagggctcagagatctatgtctgtgcagatatgcagaagaacttcctctaatactttaaaattattaactagtggatgtccctgggatttaactttcatccaatcaagggtgaaagttcagtctgtatattctttgagctccttatgttgttgaatccaaaccgaagtttcttttgttttcacttctttttcagtattaatataaatatagtattttattatcttctaagtggtatttcacccacttccttattttgagggtgattgtgtggcaggcttagttgcagggggcccacccagtaagctgcttcaaaaccctcctcagcctcaggtgtgaactggccatgctccctgttagcaagggttgatggattcaattccttcattcatctaatcattcacttagtaagtcattactgaatgccaaggctgcattatgactttcaagggccctaagctcttttgcctttgtggctccttcctgcctgaaaacatacttaaaattatattttatgactgtattgctattaatgatgactataatccagactggatccattacaatatagcaaatatattatttttttctgaaaaaacttttttgagatggggtctcactgtgtcacccagtctggagtgcagtggcccgatcattgctcactgcagcttcaacctccccaggatcaggtgatcctcccaccttagcctcccaagtagctgggaccacaggcacacgccaccaagcccgactaatttttgtatttttagtacagtcagggttttgccacgttggccagactggtctcgaattcctggcctcaagtgatccacccatctcagccctcacaaagtgctggaattacaggcatgagccaccgcgcccagtcatttgttctgattttattttatttatttcttttatatatgtatttttgagacggagtctccctctgtcgcccaggctggagtgcagtggcatgatctcggctcactgcaatttctgcctcccaggttcaagcgattctcctgcctcagcctcccaagtagctgggattacaggtgcatgccaccaggtcaggctaatttttgtatttttagtagagacggggttttgccatattggccaggctggtctcgaactcctgacctcaggtgatccgcctgcctcggcctcccaaagttaggattacagacgtgagccaccgctcccggcctttttgtttttttcttttcttttccttttttttttttgagacggagtctcgttctgtcgcccaggctggagcatctttagcatgcgaggtggtcatgaacgacaaggagaaaaaacaaggtgaaggggaatggggagtgttggcaatttagatagaatgtgcacgaaaggtttcaatgggaaattctaatttgaataaaaacgcacaaaacgcgaggaaagcctaggaacacatcagccgtatactttgccgtagagaagttaaggatgaggaacaggcaccaagaacaaatcccagcgtaaggctccctttaagtgcggctcccagggttacgtattcccattgcctacaggcgaggccgcgggtctgtaaacaagcgactgccgctgcaacctccattttgcttcctggcaccaaatctaggctgacctacttactgccatccctttcccactcccggttttcttttctttctttttttttttctcgagacagagtctcgctctgtagcccaggctggagaacagtggcgcgatctcggctcactgcaacctccgcctcctgggtccaagagattctcctgcctcagcctcccgagtagctgggattacaggcgcgcgccaccccgcccggctaagtttttgtatttttagtagagacgggtggggggaggggggagggggtcaccatgttggccaggctactctcgaaatcgtgacctcgtgatccgcccgcctcggccttccaaagtgctaggattacaggcgtgagccaccactcccggccctgggtgctggttttcttcacctccgagtgaacagcagagggggctgttgggtgagggccagaagagttggggaggcacgagggcgtccagcgctgccctcactcaagatggcggccagagcctcgcgcttggtcgcgtggggcggtgcgtgagtgcttagctcacaggctccgggaccgcgctcgggggcgggtctatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcgggtaagagcctcgatttcccctcagtctcccgcccatcaccttgaatcttcagggtcattcttccctctcccacctccactcctctgacctttttgaccaagccttgctctttgatttcctctctgtcccgccccttcggtgatatcccaagttctcatccctgaaccccaggatgttcctagtcgctcccctcaattttcccggggcctcgccgtgagattttccccaccctgcctgcagagctctcactccctcttcccagttacgttgaacagccccttttttccttagccactcctcgcctttcttgaagggcgcacgttgtatccccagactgtcatgtctactgctccccttaggaagatggctttccttcttaaggttccaagtgcttttccttacagtgccttctctagcgtctaccttcttttgccttttgctgtgtaactcctgtccgcccacatcagcctgtctttactgaactgcccgctagttcatcctacgtgtatcagggactcttgtgctcatatcctagtgtttgtgttcagtgccgtcaacactgtcacctacgggccggctagaaaaggtgggaaaagtgagagtgagcattcttcagagacccagcaagtgcgaagtgcacacctgagagtttcctctcctcatgaggggatattgttgtgattgatgtctggagctgcatttctaaggagagcgcctccttcctcccccaaacacatgtccaatgattttctttaaaaaaaatttatttcacgtgagtataattgagcaattagcgcgccctagtgttatctaagtttccagtgtttcctttagtaattggcctttagtcactggtcgcaagctccttatatctttgtgacttttgttctgtaaggctttaggtgtatagctctgaacttttaggcagttcaaatgagaggtaagaaaaccatttcaaattcttctagaacaatagaagaaacatttttctatcgggctatttattcttaaagcattatttatgatcttacctgaggtactttctatattttgttcttttgctttgaaaattttatgtctttaaaggttgttttattttttgagacagggtctccctctgtaggccaggctggagtgcagtggcatgatcatagcttactgcagcctcaaactcctgggcttaagcaatcctgctacctcagcctccggagtagctaggaccacaggtgtacaccaccatgcctggctaatttaaaaaaaaattgtgtgtgtggagatgggggggtctcactatgtttcctaagctggtctggaacttctgggctcaagtgatccaccagccttggcttccaaaagtgctgggcttacaggattacaggtgtgagccattgtgcctggccttttttttaaaacaaaaacaaaaacaaaaccccagagtagtgtcttaaaactgctgaagtgcctactaatggctgcctgactacataaacagtagctttgggatatgccacaccctatgctcatagggcactggattcagaaatctaattttaaaatatagattttaaaaggctttactgattttatatttttaaccaaataagctaaggcaggcaatgcaatcatacatctgggatatattatccataaaaagttggtcttttcagcttgctccatctctgaatatctttcccagtttgtctactaatcttatctcctacccacaaagtttgggttatttcctctgcagaatattcattttgggtgatacattttgagggtgtagaggaagaatccagcttttttcttttttttgttttgagatggagtctcactctgtcgccaggcagatgcagatggagtgtagtggcgcagtgtctgcaacctcctccccccgggtttcaagtgattctcctgcctcagccagagtagctgggactataggcagctgggactacagacacacgccaccacacccagctaatttttgtatttttagtagagacggggtttcaccatgttggctaggatggtctcaatctcttgacctcatgatccgcccgcctcagcctcccaaagtgttgggattacaggcgtgagccacggcacctggccgaaaccagcttttctttaatgcagaatcggtatttatttattttgatgcagaggctgctgagttctagctgcaacagcatattttaaaacataaacatgtaaggtgtttgccagtatggaataaatacataaggcttttacatttcttttctcagaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttggtaagaaaagatctgtaaattattaactaacttaatggaaaatgcaaaatgttaataattatgagtgcttttgatcatagaagtcattgccagtattaatatctaccagatccatgtggctgtttgaagatatattattaactttgctattcatctcatagaatgaagtgttctggttaaatacagagcctaataattactgttggccctccatatcagttggttctgcaccctatgtggattcaaccaattgtggattgaaaatatttggatttagccgggcgtggtggtgcacgcctgtaatcccagttacttgggaggctgaggcaggagaatcgcttgaacccgggaggtggaggttgcagtgagccaggataacggcactgcactccagcctgggtgacagagtgagaccccgtctcaaaaatatatgtatgtgtatatatttgggggaaaaataacaataca

SEQ ID NO: 1022 - DNA, 6514 bp, Homo Sapiens
tgctattattccaaaagatgtgaattttactattcagagtctttagagagagccctttagatagcatcttaaggagctaattccttttaaatcacatatgcaccccttagttgctgtttcttcaaaagaatatttcatattcaagaatgttgctttatttttttgagacagagtctcgctctattgccaaggctggagtgcagtggtgctctctgcaacctccgcctcccgggttcaagtggttctcctgcttcagcctcccgagtagctgggattacaggcatgcaccaccatgcccggctaatttttgtatttttagtagagactgggtttcaccatgttggccagggtggtctcgagctcccggcctcaagtgatctgcctgcctcggcctcccaaagtgctgggattacaggcgtgagccaccatgcccagcctttgctttggttttaaaagtacttacaatactcaaatgcctatgttggctatttatttttacccagctcacaggcagaaaaaaaaaagtttatttagatcaaattctgcagcaattcctttccctactgctattactgttaaagaactgtgtgccatcattaggccaagttggtgcagcacccaaaatacttgccaacttgtcttctcccagactggaggggctcaggcagctcttctaggatccatcacattctgcatctcaactttaccaataacactcccacccctcctgtaccagcgattcactcaacaaactaaattatacaccattaccaggtcagttcttaaatagctcagcagcaacaagaacaacaagatgttggtcgcattctaattttactggcagaaactgagggtttcattggtgaagaaacctgcctaggatcacagtgtcttagtttctcagggctaccataacaaaacaccacagacagggtggcgtaaacaacagaaatttgttttctcatggttctggaaactagaagtccaggagcaggcaggtttggtttcttctgaggcctgtctccttcacctgcagagggccgccttctcactgtgtcctcacaaggcctttcctctgtgcctatcatccctggagtctctccctgtggcccaatttcctctttctacaaagacaccagtcaaattggatttagggcctatcctaatggcctcgtttcaatttaatcatttttaaacgctgtgtcttcagatagtcacattctgaggtactcaggcttccacagatgaattttggaggacacaattcagaccataacacaaggcaacatatggttcagatgagatctgaatgaatgatcagcctaacctccaagcagattctttcagcagactgcaaggtgcactggagagctttagactagaggcttaagaggtcatttaggcaatatttacagaactgctaagtgccaggattgggggatgtagcagtcacgaaaatcgttcttcgtttcagtaagtttacagtttaccatggggaagagacaaatactgaacaggcagttatattactctcagtaaaataacaactgggaacagtttctggggattactttacatatggaggaaatgcaaaaaacactttgtcaggattattcctgtagcaaattagatgtgactaggtcaaccaaacatggccactgtgaaccatcttattgagcatagaagtggttttgctaaaaatggatttctccacggagcacggtggctcatgtctgtaactccagcactttgggagactgaggcaggaggattgtttgagaccagtttgggcaacaaagcaagaccctgtctcaaaaaaaaaaaaatcagggcgtggtggtgggggcctgtaatctcaactactcgggaggctgaggcaagagcatcacttgagcctgagaggtggaagttgcagtaagctgagactgcactactgcactctagcctgggcgacagagtgagaccctgtcaaaaaaataaaaaataaaaaaataaaaaaaatcaatttcccgtatacttctgttataaagaagtctttaaaaaattgcctgctcccttaagtcagccttttcactgagtttaaatttcgttccaatttgaacaaatatggatgctaatactatcctttatagttactagtgctaagtgcgttgcatgtaacaccttgaatacttactgaagtctgcaaggttggttttatgccctgattactgatggagacacaaattctgaacaactgtgacttcagggatgctaaacaccatagtgaggcacgatgcggggatttgaatcttggcctgagggttccagagctgtggccttttctggggttactctgttaattgatttctagtcctttctgatctacaagccgcggcattataacttttagatgctgaagaaaactaaactatatgtcaaggattaaggcttgtgaacccccaaaatttgggacaggtctcagttaatttagaaagtttattttgccaacgttaaggacgcgcagctgtgacacagccccaggaagtccagatgacatgtgcccaaggtggttggggcacagattggttttatacattttagggagacaggagacatcaatcaacatatgtaagtacactggttccttccagaaaggtggggacaactcggaagcaggaagggcttctaggtcacaggtagatgagagacaaaaggctgcatacgagtttctgataagcctttccaaaggagacaatcagaatatgcatctatctcagtgagcagaaggatgactgactagaatgggaggcaggttttgccctgagcagttcccagcttgacttttcccttttgcttagtaattttgggaccctaacattttcacaggctttaaattttattattctttagttactacgtgctagcatataaataaatagtacaaaaccaagaaggcatccaccttttggttgtctcttcacgtgtaaaacaacactttgtgttaagtatcttcacacacggcggcgcaaaggtagaaaccgatactaaaaaagcgtgtagaaaatagttcccagcctgggcaacacagggagacctcatttctacaaaaataattcgccaagcatagtggtgcgcacctgcggtcccagctacttgagaggctgagatgggaaagttgcttgagctcgggcagcaggagttccaggctgcagtgagctaagaatgcgccactggactccagtatgggcgacagcgtgagaccctgtctcaaacaaaaacaaaagcccgttactccaccaagaaggcgcttttgcacattgttttaatgcttaacgccttcaggatgccagcgtgacggaagcaagtaaccaccaaggcatcaccactggcgctaaacttctcacttccggagtgctgcaagcgcagaaaatatacgtcatgtgcggaggcggagcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttggtatccttaacgccgcgttgggacttggggtgcagggattcggggctggattcctcgcggggctctgccttgggcacagtggcatctgcaggatgatggtcttgggtcggggtcggggtcgctatagaatctctgtcactaggttttctaagtacagtcgtccctcggtatccccggggctttggttccagcccctcctccgtataccacgatgttcaagttccttcaactcccttatataatggcgtggtatttgcatataaactacccacttccgtaatcttttaaatcgtttctagcttacttgtaatgccgaatgcaatgtaagtgatctgtaaatagttgttatactgtattttaaaattttttgtagtttttattggtatgttttatttatttatttttttccatcgcaaatatttttgatccgtggtaggttgattgcggaatcgggtgatgaggcgggccgccctgtctgctttccccagctttgcagtcttagcggcctgtgcatcctggtttgtcactttgtggcagtgctttatgttcctctctgccttagttctctcatctgcaaagtagaggtggtgatagtatctacacacaggattggaatgaggaataaagaaattgcctacatgagagaagtttagtgcgattaatacagtaaatcttaaagttattatcctgtccgggaggtcagtaaggagagcagagtagacttcgacgattagttttgcttgagtcttgccccatttatgtttcttagaggaaggatagtgtggacaggtgttttacccattttttaaattgactttttaaggactattgtttctgtacatgtttggctggttttgtttgtcattggaattaaattcttttttcattagcaaaacgtgatactgcttttgaaatttttatctttttctttgttatgtagtcattttttttttttttttgagtatctattctggctcagaatctggtgataccttacaccaatttcctaaatggggatctatgagtctaggggctcgtgggcttgtggaaagagtcctgtaaatgattgcggggggattggggacgggaaatggagtgcaagagtgtgtgggcgttcagcaaaggaatccctgactgtggagccctaattcttcagtaggtacaaaacttataaataaaacgacattgataagttttaaaacataatgagattatcattttttgcaagtgaataatctttaaataaatctgtaattgatttttggcttaaaagtttttatacagggtactttgaattggggaaagccaaaggatttttgttttgttttgttttgttttttgttttttagagcacatgcgctgttgctgccctcaagctgttgcttagtatcattgcagtctaaagattttctcagaaataaagggtaaaggttagttttcagtgacaagaacccttaaaacttcagcaaagatttagatcattttatgtagcagcccttgtgaagaattactaaagaggactgtggccaggctcagtggcttacgcctgtcatcccagcactttgggaggtcaaggcaggaggatcatttgagcccaggagttcaagaccagcctgggcaacatagtgaacccctgtctacacacagtcaaaaaattagctggacgtggtggcctgcacctttggtcccagctacacggaaggctgaggcaggaagattgcttgggcccaggcggtcaaggctgcaatgagccgtgttcatgtctgtctctgaataaataaataaaaaggactgtgaaagacattctagtcatgacaacctcatatatttataataaactcgtttatgtcaaaggagtatatctgattacttgttctacaatcggttttgctttatttcattttcacgggaattcagacacctgaaattatttagattttattgtattgtttgttaatgacaaacttacccgttattatactagtttcataatttactcttgtatctctatactaaattgtttggtctttaaaccatctatatagcttagtgtcttatttatacagtctaaatgtctgtgtcaaataatgcagaagtaagttaaacttttgtctcttatagattttaatgtttgtaatatgcgtttaagtgtattagcaagatattaccatctctttaggctatgtatactaatggagatttttaagtcacctaactaaagaactaaagaaacttattttttgtattgaaatgttattggtctttgggtcttataccgaaagtgatttttggctttgctgcagattttaacttttctgtccgcagaaatttaattttgcgtatataaacttactgaaattagacaagtcaaattatacaaatattttcagattgtctcatttttcatatttcttgtctaacaatttatgtgaatattttcaggtcgtctaattttacatatttcatctctaagaattcaagccaaaattctcaaccctagctgagaattggcattacctgt

SEQ ID NO: 1023 - DNA, 6325 bp, Homo Sapiens
agcctcctgagtagctgggaccacagttatgcaccaccacacccacctaattttgtttatttttttgtagagacaaggtctcactatgttgcccaggctggtcttgaactcctgggctcaagcaatcctcccacctcggccaccccaagtgctgggattacagatgtgagccatggtgcccagcccctctcctggttcttgattgtgtttttgacagccgtgagatggtgttgtcccactaagtaatatgccctgtcactacatcataactttgcagttgttgggattctacgtaaaagcacttcactttaatgctgccttaatttcctttatggtactatacttggggggaaattttttcttataaataagaatcctggtcctgggcattcatagatggtatttaatttactttttccaatgcccttgcaaaatagatgcttttcctcttttgccagctgaggaaataaggttcagtatggttaaacagtcggctcaggccacacagctaacgagggagaagtcaggatttgaactcgagtctcatttcaaaccctatcttgttatcgcagcagaacctttacctattaaggctaaggacgtttagatggctttgtgcttttgcacctcatctgaaaaatgtttttaaaagttggcagatgagttctaattgtggttcctcatttttttcctcatgtattttctgagtacgaggcttggctgaaggccagttcctaggtgcccagggaaagggccactttcttcaaaacagtagtagcccaggttagagcttacagatgtttcagctccacgtggtaagcttctttgggccctcacctgcatatggagccgaagaggtctgttttctgacagagaaacaaacccccagggtgctgagaatggtgacaggatgaacaggttgcaggatccttgccaccaagtgacatccaatgctgacagtgagtgacggcttccccgggaggtgctttccagagcacacctcgtcacaccaccccgacagccaccttccccgcaagattgacataatcattagctattttcatataaatgcaaaagtaaaccttctcagtgtttctgggaaatttcatgctgttacatcccagaaaacgatgttgatcctctggcattctgtttgacactgatactgaataagagcagtggaaagtcagtccccgtgaagctctggaactactgtgacctcgagtgtcagtatcaaaagagcccatccaaacatccttggccacgtcgctagaaaacagtgtattggaggcaattttaaaatgctttgaacaattttgtttttattttcttttgcttttggccacagtttagatacattttaggctcactgccctgtgggtgaagacaagctgggaaatgtggaagagtcttccacttacccatcagaggttccatttgaattcagttgtgagtctgggctgggagcgcaggaagcggttgtgttgaatgtacagcatgaggggatggtggggttcccaggtgtgccccaaacctcctgtacctatacagagatgaactctttctgcagcagcctccagtgaggaggctcaggatctcaagtcttgagggtttctgagcctgccataggccagggacagggatttggctgctgatgggtgacatgctgccagctacagaatggggctgactgggcactgggagcttggtgatggggtgtcacggacattcctacaggcccagcccgtgtttagaatcacagagctgagccgatgcatgtcacggagaactgcctttgccctgtacacgcatgctgcattaggggcctgccttgggcggctcagctggccgcgcctctgcttgtttagggtgagcctttgcacagggcttggctttgtggagctcatttggtggccaaagatggtgttgcagccccagcccgctcgcaggcccagtaccttttgctccctagcttgccccaggccctcagactgtgcggtgcaaaggtccttggaggctagccccgggctggctgtgaggggagagccaggtgccgcagctctccctggtacagacttcagctgcctccaggacccggggcctgaaggaggcagaagccggcggtggaaaagggcgcacgtctctcccagcgtcgctcccgctgcccgctgcccactgcagcctatttacctgttcctccagccatccccttagtcctgggccgggagagaccatttcctccttcctggagggatgagccaacagggctgagccccctactctctcggtggtcagcccgcccgaccaccacgcccctcctttctagggccccagctcccgggccgcggctcgtttgcatttcaaagctacacaatgcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgtaagtgctccgcccgggccgccccgagtctcccggggaggaggagaggatgcccgggctttgttagtgtcgcctttcctaatgcctgtgcaacctggagcccaggctggcctggggttcttcgcagccttggaaagctttacctggggctgctctgggaggagcatctggtagccccaagttactgctgtgggcagaaacgattccctggaattcagttttggtcgctcagcagtgggtgcatggctggggggcttctcctgccgtcagcatctttcctctgcacccccggcacagtggtatttcctgcaagggaacagccaggcatcagcgactgcctcctcctaggaagaacccatgagcgtggcagctccgtgcccggggcgacagcccagtttccgggcagctgcgcttgtggctgggcagatggcgtggtgcgctctggtggacgttccgtctagttagcctaagcatcatccacatactctggtgaacactcgaggacaaggccgcttgctattattagtaaagggccgaaccgtcctgtcattggtggaggcagtgcttgactgtgcatcgatccaggaatccgatcttttctctcaaccacagagctaacgtgctcagaagtggcctttatcctggccgagtgtttattagaattcacgtttctgttatggtcgtctccattacctacccaggcatgtttggacgatggggcgtattgaatgggtctgccggccgggtcgcatttcagcaactcaggcttgtatccaaagtggacctcccagcctcacctgcccccacttttccagagagaagactatgtttcagagaagagtattttctggggacttgggggtaggggtagtaaagtgggttcttaagagtcatggatgtgtagattaaaagatggtggggattgatctgtgtgttgtaggagggatggggccccggggggtacttcctcactggtccctcgacccctgggcttcagtgaggagctggctcggcgtagtgatgtaatgctaggctgagcctcgtggttttctgggctccagctctttagcagggagtcattcttccgagcaggtgtgcacccatcatttgtcttcacccctgtagcttgagaaagcatcgtcttacaatggaggcacatcgcgtttgaggattttctttttaaatgttatgatccttgtgctgtgcctgccttgtttctcatgcacgtgtagtgttgctaggtgcatggaaatacaactcgagtctaggcagaaaagaaccactttaacctattttttgcaagtccctatagtggaattgagttaatcagtgacaggcactggccaactctcacggctcagacctatctagtgaagagcttaggaaacagaaaggacaatgtgactgtacgtttgggaaaatgtgctcctcagtcattggaaattcagctcgccggtccctaacgtccccgccctctttttcagctgagttaataaatgatcagtgttccgtcagctgagggccgagtttagatagcttctgttaggtagctgtgcctttttggataaggtcccttaaggttctgcccactgggatagtggtgtttaaataaaatttcaggctgaatggccacattgtgatggaagctgtttatcaaatattttcacagttgagttggtccatatgcccccgcctgaggcttctctccctagaactgctgcctctgaaatgtctctaaatatagatctttacgatagtatattcactcattcacaaaatcccaccctccatcccgtaacatttttgttctaaaaaaatggagagagaggaaatatttggggccagtgccattgctagcatctgtcctcttcaaaacccgtctctgctctctgaataactggggcttatttttctagtgcagatgtgctctttcccagtctagaggttttaaaaatatatattcggagagtgcctcttttctgcccaggcacaggtctttcttggtagtatttccatgcagctaaaaatgcatgcacgtgaataatacacaagacagcaacagagtgtggggcccatggcaggaaagaggttgcattgtaagatgatgccgtcagggctgcagggatggtgacaaacacagggtgcgcacctgccgcgggggacagctcctgacaaccggaatctagagtgaatgtttccctttttctctgctggttccctgtgaaagactggcttaaggagggccatggtgtaagagtgaaatcaaaagatagaggatttggaagtgactgaaggatttttttttaatttaaattttttagttttaagatttctttccttccaattgcaggtttggggtgcctttgggcagcttttgtagctccagctgacagcttcattctatgcaggagtgcattgggctagggagggagcgacttttgtatctccccttttgagaactcaggcatcaagattggagtagcagaagtcccatgggactggggattgaagcctgaggatgaaggtgcaaatggtgaccagtctcttgctactcccagggtcggccacacatgacagcatcagcttcccaaaggggcttgctagaaacgcagagcctcagacctcaccccagaccagctgaatcagaatctccatttcatccagggacttgtaaagatgcccaggtgatttgtaggcatctcaaaatttgagaagccatgagctggttcagtcttccctccatcctgtccatgagaaacagctggccacttctctgactgctcctttcctatctggcaaagaagttcttgtagcaatagtgaccatttgtttctaaatagaatatgagtagcaaggggagggagaattctcccacagaaaacacttatttctcagtatggatggtaggagacacaggaatggacaggaagtacttgagtaaatgtgggctgcagctattgatcagacctgctgttcatcccttgattctgtggcagccccatgtggtgtggcttctgctaagtggggcagcattaagtactttgtcctttatgtagttggagacccccgtttcaggggttccctcagcttccaccaaatccccacaccctggccactgaaaaccacccagggggccattatcagagagcaaaagcggtggttctgttggcaaagtcggcctgccccgactgttgccctactctcaaagtgagcacgtgcccttggctctaaaaaacaaatcacaaatatggaaacccatactctgtagacctgtggatcgaagtagaggggccagggtggatgggagagaagcgatggaggaggaagcaacaggctctgtgattgatgagatgggggagggaagagaagagacagtggcaagt

SEQ ID NO: 1024 - DNA, 6214 bp, Homo Sapiens
ctgacgagaaaagacttatacacccagtgggcccctggctcctttccttctgcctgaggccctgagcatcaccctgggaggagagaggaagcaacttcaaagttgagtgagcccggagttcttatggcactttggagctacttctagaataggggaagttggtaccccaccctctggaaaaggggtgtcagccagctgtcaccatcatacagccctgtgacccctatagtctctcttatggaggcccctcactcagggaagggaaactcaggcctcctggaaggagagggaagaggaacaggtgttatatagggatgctgaagggctgagaggcacagcatggaagtggggagaaaagcctgagcagaggctcctacccccaatatatacatactgagtgggaaagggacattcttcttttttttttttttttttgagatggagtttcgcccctgctgcccaggctggagtggaatggcgctatctcagctcactgcaacctccgcctcccaagttcaagtgattctcctgcctcagactcctgaatagcttggattacaggcgctcagcactatgcctggctaatttttgtatttttagtagagatggagtttcaccatgttgtccaggctagtttcaaactcctgacctcaggggatccacccactttggcctcccaaagtgttgggattacaggcgtgagccaccgcacccggccagggacattcttttcttcatacaggtacagacaggcacctacacacacacaaacacacacacacacacacacacacacacacgcacacacatacataaggacaaatatgtcagtacacagttaaacacattcataggcaacaccctctggcacacacacagacacacacacacacacactgctcaaagacacaccctcatgcactctcacagtcataacaagtatgtgtgtaatgaaaaggcacatgcttgttttacacacacaccatcatcaaacaggaacacacaaagaggtacccaaatatatacacaagctgtcattctccagtgcacacagaggtccaggtgtatcagacactcacagagacctactgctcacagtcacatacacatacagatgtacacatacagatgtacacactcaagcagggacacacaccgtcccctcccccccacctactggggtctcttgaggggaatctgcacccatattcctctcctctccctctctccccaggggtaagacagatcccgcccaggagagaccataaccaggtaaaggggcctctggtggcaatgcaggggaggggcagaggtcaggagtagcaaccctgccaggcaggttccggaagctcaacggggtcccagcgcatacccggtgcagccccaactcaatgccacctcagtactcaccgctgctcgcccagagctgagaccgaggagagacagaggagaggctgggcccagctgagctgtgaaggcagcgcggctcccgtttgctccaggcccgcccgcctctcagtccctccccctaccccctacgcgccgctcaggcaacgctaatcccccccaccccccgccctctcccagggcccagagccccggaggctgccagccccccttgtcgctaggtccccgctgggctctcccgccaacctaagacccgccccagacaaggaggagggcgcatggaacccctggttctattccccagaccctcacgtgccccaccccacttgtgtccacgtctctctcgcccaccgccccttgagccacacgtaaggcccggctgcacacgcgtgtcccgctccagaccccacgcgtgtccctaggaggctgccacatgacctgttacatgccacacgcgctcccgcccccacgagcacgcggccgcgccaagcacacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccaggggtaagaggttagacgggatgaactagggaccggaagacgtgggggaccggcaacccttgtgcccttggccagggtagaagggggccctgctattttaagaaagagccgctggagttactatggcaactactctctttgggagggccagggcgggcagatggtgacctcggaaggaagaaggggtctgttcgggcagtcagggggcgcgaggacgtgcgaggcgggggcgcgcggggctcaccgcggggaggggcggcgcggactccgcgtggtgctgaaggggacagcgccagatttgtcgcactgcgcaggcgcagaggcgcgaacaaagaggggagggggacgaggcgcgcggccggaggtggtgcgcgctcacgtggctctatctttgcaggggtctgtcctcccagctaccccctccctaagcaggctgaggaagaagagatagcaagccctcacctaacttgacccctttcttgtctctccccgctgctagcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggtgagaggcagccctgaagctgagtccagaggtctggggcgtcattgtcccagggcggacccagccccagaccctacaactaaacccaaggccagccgagaagcactaccactggcgggctgagctgagctctcattcttcttaggactctggacctttggaggaaatgaaagggacccagttggaaatatagtctttcttcgcgccccctacatctctctcccccggcggaaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacaggccaaggaggcgggtttggtgcggccactccaaggccaaagcgagaaaatcttactgcgcacgcgcaatagacagccgatggagccaccgatggagccgtccggaggggagcaagagcccggagccgtcaggtaccgagcaccggaggggccgagagggaagaggaacctgagggaggggagccgagccggggctgggtctgggggccgctcttgggagctggggcgcaggaacataacggaggcggactcgcaggtaatagtggccccgggacgccagtgccaacgcccctttactcgcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgagccgggggctgaagccccgcccctgcctgggtaccgccccgcctctagcccagcccccagccccgcagtatgcccttctggacccccttgggccgccggggctgcccggaagggatccacgcaccaaagggcaaatactcggtagcgactcagagggaaagtggggtctctcctgggagagcaggaggctgccagaaaagaactcaggtcaggggtgcataggcggctgaggagtgcgggacgggctgagagttggggtgcctccccgcccgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggtgcctgggcctgatagggcgggaggagggcagtcacttagcctctgctggtatggggcgggctgtagttgttaaaaggccggactgagggttctgaatcttcctgcaaaccacagcacccccattctgaacagaaagggcctctaggattgcctaggccagagagcccatagtttaaaaacttttttcaaccaatgtttacacattgggagatttcacatagaaagtcgacttctggcttttcttcaacaagggggagatcttgcaatcctaggcggagctgagggccaggttccccccttaaatgagacaggaagtctccagctcactggaagccaatccaggcgcctcccttgtgtagggacggaaaaagtatgcccctgccccgagctggagggagaccgggattttgccggagccagtccgaggctgagtgagcccgggcctccaccttaccccaccaaaggtgtggtggcctcatgtccctagcctcaccctgctcctccctcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccctcttgcctggtgctgccctgttgaagataggggattcgaggttggggaggaaaggtcagacaggcatagtatcccagtcctgaggcagaaatgaccagaatgcactcacaccttccttgggccacctttactgtgcccatggaggcagctccgagagtaggttaacactatggagcaaaggagtagagaagggggacaggagttagggggcccctgtgtaggggtatagggctcctgcatccctctgggatctgagcctagaaggctcgggcagagtccggcgagtgcctcaatggaagcggtactttctggctggcttgaggttgatgtatgtggccttcatctcctcggcctcagggttccgcaca

SEQ ID NO: 1025 - DNA, 6323 bp, Homo Sapiens
tgtgtaggtgactggggtgaagagaggttggcgaaatgggtatgagcatgtgggtagatggaaggaatacgttctaaagttctatggcagactagggcgactagaggtaacaacgatgtattagagtgtgtttccaaagagctggaagacagcacatgagttgtttccaacaggtagagatgacagatacccactggatggatacccacagatactgtacaacccctcagttgatcatggatcattacgcaatgtacaagcatcaccacatgtcacaggaatcccaccaatatcatgtctgcatgaagaaaaacatagtcatgctacaagagtgattgtcacagctctccctccccagcgccatagcccgtggtctcggctcctcaagttctgctgccatttctaccaaagccgctgacacccgtggagcccaatcagggatcccgcgctcagggtctggcatgccttggaaaagccagtgagcttgctggcatgagtggctctggcgggtggcccaatcattaggcgtagatccccctcagccgagagagaagtggcccctcagccacccggcttggactggcggaagccgctctgctccacactactggagcattccgtggccagaagagagtgcgagggtgctgctggtggtggtggtgggtcacctggcgacaatccgaggagaaagcctgacctggccagtgggcttggccgctgagaaacagtggcagcgaggtgagcacatgacaaggaagagctgcaaagccgatgttgcgaaggtggcgtcagccaggccaaaaggacagatgggtggaggtaggtagcacaccctccaaacaccgcaagcctccttccccggcgcacaggcacgcagccacaggccaagctgcgacgcgagctccgcgcgcgggatctccgcaaaaggtccgcccgatgcgttgggcgggaatcgagcccgggtcaactgcttggaaggcaactatgctcaccactataccaccaacgccgcacggcgcgggcagccccgccgcgccggcccggggctcccaccagcgcgccgccgacgcccggggcaggccggccccgacgcccggtccgtccgcccgcccgcagctccgcgctgccgcggcctctccaaaggccgccccgcgccccaccggtgcaaggccagcgcggctgacccgttacgcccgcctgcctctgggggcgctctcgctcactcgccgcctcgggcccccagagcccttccccaacaggtgcccgggggggaaacggccggcgccggcagggtccccactcctacgcttcccaccgggcgcagggccccgtgtgtcgcagaaagcctcttccgacaaccactttgagccggcagctcgttgggcgccgtgcagggccagaggaggcctcccggctgccgctaccaagccgcggacgagaagaaaagacaggaggccaaggaggcccagaaggccaaagggccaggcaggccaggcccgagatggcaccctgcgactagctggagggcggaggaaggagaaggagggcccacaggctgggtccgaggcggcggcccaaaaagcacggctgcctccccgtcggggaatcgaaccccggtctcccgcgtgacaggcggggatactcaccactatactaacgaggacgacggcgacggtcgccgggacgccagaccccactccgaccgcggacgcctagccctgccttgatcccctcccccgacggcaggggccgggcgcgtgctcgccttccacccgccgcccgccgcccgccacccgccacacgccacccgtcacctgccacccgccccccgccaccgttggcacgacctaccccgacacccaacaaagcaccctgcgatcccgctgggacccggagccggagccggaccccgacaggtaccggagcggcgtggaacctccccgcgcgccctgcctgctgtctccaacgcggggatcgcgccggggcaggaggaggcgcgggcgaaacagtcaggccgctgctcctaggacgcggtgggcgcacgccctgcggggttcggcgagcggaggcgcgggggctggggcgtgcgccggcggcggccggcccgacgcggaccctttgggtccggggtggggacgcgggggcgtccacgccaacgccagccggctccgttcacttggcgcccgctccccccgcgcggtccgtcggttgcgcaccgaacccagacaggcgccggccaagggcgcaggcgttcgcgccgggtcccagccatgccagcggcgaagcgccccggcgcgccgtcaggatggccgagcggtctaaggcgctgcgttcaggtcgcagtctcccctggaggcgtgggttcgaatcccactcctgacaagccgaccttttggcccgcccgccggagggcaacgcccatggcaaccctggagcacctttggccgcttcctgccttgagcccttgcccgctctccagactccagcccccttgaagcaagcctccaaaacgccgccgcttctcaggcacgtccgttcttcctgcccacccgccggctgtcgcagaaacagcccaggaccatgcgccagcgcccgcgaccctctaccaattgcccttcggacagacgccctccccaccacctcacacgccctcttccctggccccacacacagcgagcgaccgcgaccaccttccacgctcttccctgcctatctcctccgcccgccttctcctcactcgcccaaacagacacagcccagattcttcccctattcctccttttccctccttcctcccaccggcctccgcccaccgcccaccgccttgaatcgccgctgcgctgcccagaggcgtcctggcctgaacagcccgcccggtttcaccctccaacttctgaccgctgagcagcagcgagcgactcgctcgtggagccgcacacacgtctcccaccagaggcacgccatccaacatcctgtcctttcctccgacccctcggaccccggccgcgcattccattctgccgacaccctagccaggtcgccgatcccacctcgctacctgtgctcccttcccgctaacacctgcctgccggcccacctgcagcccggacgcctgccggccagaggcagcgggaaccctgcacacagccgggcaggcgagtccaaacccggaaagacagcccaagaggaatcacgagcggaagccctagatccccgtcacccgcccacaaacgcctggccccgccgggaccagctctgcgccacagcgcatccccacgcgggaagccgcggcctgggccgtcccagccacacccagcgcgccttctccagggtcagccagctgcggctctgccgaagcgctcctccgctcctttctcgcgctccagcctccctaccagcccagggggccggaccccaagtgcgagccggtggcgtgggtcagagcgcaggagcgaggcgcccacggacctggtctgcgtttctgagccgcacgccacggctgcgagacccgttccccatcgccgcccccgctcgctgacacacccatcccgcctctcacctgctggtgacacaagtgagaaggctggccccacggtggtgaaaaaaaaaaacaccacacgaaagaaagaaagaaagaaagaaagaaagaaagaaagaaagaaagaattctcgcctgccacgcgggaggcccgggttcgattcccggcccatgcagcacgccctcccattttggtgctgcagcagcaccaaggcgtagctgcgctcgcctctgccgcctccttacactcggggcgcgcgagcgagtccggcaccggctgcgctcccacgcgcgacggccctctgccctttcttccgtgcctctctcgactgacttagggatgagcctaccccacgcacccacacaccttggtgacaacaacccctccagacacgagagcgcgccagacaccagaacttggcagcctcctggtcctgtttctcttcattgccctgccaccgcctctgcccgacgcatttcacttcacggaacaccgccaggcaccacgggcttgcagccactcgcaccaccccttctcttcacatttcaccgcctcgacctctctctctctctctctctctgtctctctcccccccccccctcgctggctccccacatccagaaaatgatgccatggttgcccttccagtaggaaggaagtcgcgactccagggagtaactcatcactttcccctagttggtcacacagtccttaacgcgaccacacgagtgtacgcgtggcatgtgcaccgtctatattcaccgtgttccggctactccacactctctcccctcattctgccggcaccaccaccgccatgtcgcaactcccaacctaaccccaatccaccactttagtcgaggatgctgccttgtttctccccctcggacctcttttcatctcagccccagacacatgcctgagacgtgaatgtgcgtcctgaagacggcttatttatgtctcgggtccagttgcattccctacccttttgggacgtgggacgtggcctccagtcgctctgtcacgatgtctctcccaccctgggctgcttgccacctcaccccagccccactccatactctgaccgcccagcccaagcagcatcccagtctcgccggcgcgggtcccctttgaccacacagacttcgttcctgcccagaccaaccggctgaaaatgtactgttcccaccagccttcaggctcagccctccctcccccacctttgtctcacgccacccaccccttcactcacacacacactctgacgcgcacacacacacacacacacacactctcactctctctctctctcactctctgtctttctctgtctctctctctctctctgtctctatgtctctatctctctgtctctgtctcacacagccaactctccgtctcgccgtcaatgcccctctctcagacgactcatatcccccagccctggcctccttcagcctcttcagactcacgccagctccgccaccagctgggatccctccgacctatggcataggcagcccgcgaggtgccctaacgccccaggcatctgcacaacctccgtttgactgcacagcctcactcccagacctggccagccagccctgtgcaccccctggacaccctggactccttcttccagctcccagcacgcgacatgcttctctcctttccttggtgtcagccccttgccccgggctagggtggacgccagccacgggatcggacaccttcttccgtcgctgtcacccactgacatccacccacaacacgctggcaagcaagccagcctcccgtggggatggcaaacatctctatccccgatagggtctggtccctgcaggtgatccgactgtgccaagatcccacgaatgacacgggacaggtttgtgcagttggttggacgtctactttgcccctacagaggggttttggcaagaagtcgactgacttctgccattgacctggggaatcagccaaacaataagatcagtacgggttgaatagagggttgtagaactgggctcatctgtgctaaggaggggaggggaaaaaaagtcccacagcgaatcttggcgctggggataggtaccatctccacatgttccttgacatttggagagacgatagagagcgtaggtcaggcaatgggaagcaaacttcggctagaagtctgtcaggaaccccaaccccgcacatgcgctttggtcagcctggccgttgggttttccccacgaactgctgcatctccacgcttcaatgcccgtggccaggttggtctgactaatgggacctctcaagattcattttcacatccagaataggcgagaatctcaaacctgtcgacggtgagcgggagcatgtgtacgcacatgcacgtgtacgttgcgggaagtcagggaccccgaacggagggagcggctggagctgcggccgaggcacgtaaattgtgaggatttcatttcaatacggacattcatcagttcccaaataatgcttttataatttcttacgcctgtctttactttaatctcttaatcctgttatcttcgtaagctgaggatgtacgtcacctcaggaccgctgtgacaattgtgttgactctacaaattgatggtaaaacgtgtgtgtttgaacagcatgaaatcagggcaccttgaaaaagaatagaataacagcgacttttagggaacaggggaagacaacggtaaggtctgactgcctgcgaggtcgggcagaaagagccatatttttcttcttgcagagagcctatgaaggacgtgc

SEQ ID NO: 1026 - DNA, 6518 bp, Homo Sapiens
tataaaatggagagaatcctaatgcctacctcataggactatattaggaggtttaaatgagatatgatctctaagccacttagaagagtacctgacagtgttatgtaactgttagctagtattctaagcccttgagggaaggggaagccggaaggagaagatgtttgggaccatggaggtcatgatctcaataactggcatagactagaactctgctacaattatcagaggctttcagtgttaagttccaggggaagaaactctgatttgattaccatgacatccccaacagctgtgggaatagcctgtgcagatggagtatggccatagcaaataggtgctgaatgaattcataaattgctgtgtcagtcatttcccgaaggagccccagaattgaacggccagaagaatctgtgaggaagcaaagggagatccacttctctatccacgtctggtcccaaagagaaatgaggtggtaggcagagggcaaggactcgtcagaggaaacagtctcagagtccagggatgaggagggggtgcccaggattgtgtggactgtcacatcacccccaggtggaccctcccagctgtacccagctgggaattcctgggttcttgggacccagcccagaaaactgccttttctgggattcatcctgttcattcccttgatggttagacagtggattaaagggagcaggaattgtttctgggtcgcccctatattccagtgtccaacaccacagctggggttcaatccagttctgtggaataagtgcccccaaagacttctatgcttttcatccttctgaacccaactcaaatgtccttttctctctgaagccttcccagccaccccagccagtgtacttggcatctatgtctattgttttgtgatccatattagctgtggatgaataacatcattgcaccctcagcattccatataatgccaggcacatagtaggtgttcaatcaatgcaaatgaataacttaatgctcccttagtaacagcaaccaatttattcagttattcctcttgttggcacttcaagagacacagaagaagctaagatcatcatctatgtatcaatcagacaccactgaggggtccctccctccagtttcatcccggtgcacttgccagagcactcacagactccccatccacactggtctgccctcctactggccttccaccccatctttgaggcatgagaagaccaacagcccggtaaagccacggggcttccagatcagctggagggggttgtgccgatgtgtgtacatacagagggctcagggcctttgggggtttctctgcccttcaattccgtgcagaacacctcactcagtgggaaagtgagccaagctttcggtgccaactaggaagtgatgaggatgcggcgaccccattgacccacccagcaccgatccccaacgcatggtctccagcctgagctgacatcccatctaccccggtttctccagcacccaagcctacctcctcgtcaggtgacctccccggagcaccgactggggtcgcaggcgctctgtcccgccgcctccggagcctgcctttggggagtgggggtggtcgcaaccaccagccgcgaggagaggattgcacctctcccccccggccggcatccgaacagagccagtctccacccctgcagtggcgaagtgtttacaaagtccgcgccgcgccgccgatccagagctgggcaggaagtggggaagagggggcggaggagacaaaggggctggtgctctgctcagccaagtttcggtccccggcctgactctcccaccccctgtacaccctcggcgaggccaggaggctcatccggcgccgcgcacccccgcccgcagcccccgccccacgcggcataggtgcgggggcggggcgccacggaggctcaggtgtgggcggcggggccggggcagcacgggttcccggaccgctgcctcccggcgttggcaactcctccacgtgctatccaggaagtaaacaacatcatgaggagcgacttctttttctttttcttttttttgagatggagtctccctctgtcgcccaggctggagtgcagtggcgcgatctcggctcactgcaacctccgcctcccggattcaagctattctcctgcctcagcctcccgagtagctaggactacaggcgcacgccgccacgcccggctaattttgtgtatttttagtagacacggggtttcaccatgttggtcaggctggtctcgaactcctgacctgaggtgatccacccgcctcggcctctcaaagtgctgggattacaggcgagagccaccgcgcccggccgatttcttgactcttactacacgtcaggcactgtgacagactctttctgtgtatcatctcatctttcccccagctttacagaagaggaaactgagacacactgaggattaaggtcaagtgcccgaagtaccatagctggctagtgttaggatccaagcccagaatctgcgtcctgccaggcacctgcaaatggggacgaacacggcgcagctagaggggctgacaggctagggagaaaaccactggtagccgcgggcaccccacgccctgggagtgaggcggcaagggacaagtctcccgccccctagacttgcctcgcaaatacttgcgggtcgagggcgcgaaggcagcaggatgcagcgatagacttggactaggtggtccaggctctacttccaagtgggccattgacaggcggggcggccctcagcacaaaatcaccaggctggatgctccagggtttcccaacattactcgctcagaagaatcatctggggagctccttaatgagaaagattcccaagcccctcttccagagagtgaagtcactgggattgggctgggcccagccaggtgttactaataataagacaagtttggaaaaccctgcgagtgtagatgatctcctggtatgctctttataagaaccgattttcatattaaaataggtttcttttaactcagtgaaaccgggcgcgttttcctggcccacaaccaagccactgaaggccccagaacacttcactctcaaaaggtcacgtgaggctggcgcggtagctcacgcctgtaatcccagcaccttgtgaggccgaggccgcggactgcttgagcttaggtgttcgagaccagcctggccaacatggcgaaactcggtctctactaaaaatacaaaaactagcggggcgtggtggtgcccgcctgtaatcccagctactccggaggctgaggcgggaggatcgcttgagcctgggaggtggaggttgcagtgaaccgagatcgcgccattgcactctagcctgtgaaacggagcaagactctgtatccaaaaaaaaaaaaaaaaagtcacgtgagccggggtcaccggaggcgtcccccaaccgactgggcttcggaaaaccaaggggcgcacgccgccccgccccgccccgccccgcgactacaagtcccatcgcgccccgcgctcgcgcacactacgccagaacaagatggccgacgcggcggccacagctggggccggtggctccggaacggtaagggcaggaagcgcgggctcggagccgagagagtttgggtatcctgcaactttcccctcgactgagcaacaagataatgcccagaaattcagccccatcatgagctccgactggcggagggtgttttcaggccgtaggcgccccctccttgggacttggctgcggcctccggagttggcggacctgtgtcttgattggctcgttcgctgttgggggttgggagcccggaacacccccgattggtctgaagatgccgttttcgccttcttattggccggccaaagttgaaaggcattcccgtttcaaaatatttagctttcttacttttttgtgcttttatcttttgccctcctctcctcgcggtcacctcttgttactgttttcattttccctttcaatgaaatggtgtgaagatgggaggcacaagagagggatcctgttttttctgcgggacacgtcttaatcccatcatgcgtgtttcttcagctatgtattctaataatctgctaaagtagaaagtaaaagacctgctattttatctcattgggactgtacgttttaggtaagcggagaagtggtctctgtatttaaagcaccttgggtgctcaatttttactcagttggccaagatctgtaaatctaaacattaagcactgatttttaaaataaaattatttagtaaaataactttgcttgccgttgaccacgtatgaactatgtgattgcatccttctcctgtggatgaaaatctctctgctgattcacagagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctgtgagtacatggaaacacttggccttggagtcaaccccaacatcagttctgtgccctgctttgtgatagtgtttgagaggatttaagaaacaaacttttttcttaagaggggagaaaaaaaattttttttaatgtaaaaagttgagaaaagaaaacagcacaatgggccgagcgtggtggctcacgcctgtaatcccagtactttaggaggctgaggcgggtggatcacctgaagtcaggagttcaagaccagcctggccaacgtggcgaaaccccgtctctactaaaaaacacacaaaaaaattagctgggcgtggtggcaggtgtctataatcccagccactcgggagactgaggcaggagaatcgcttgaatctgggaggcagaggttacagtgaactgagatcgcaccactgcactccagcctgtgaggctccatctccaacaacaacaacaaaaacagaaaagagcataatgaagtgacttacaggctttagaatcagatagacttggtgtacatcatcactctgtcacttaatagcttgggcaagccactgaatctcctgaacctcaatttcctcatttctgaaatgggataacagtttctacctcatggatttgtgagtgtaagtgagatgtatatataaaacattcagtgctggggagattttaagctcttggtgagttatgggtgcccttaaggacttttgttggggagtcaggactaattccccatgcaatagatatcatcacattatgtaatgaaatgctagattgtgtgatacaaagaatgaaggggaaaagccccccccccctttttttttttgagacagagtctcactgtgttgcccaggctggggtgcagtggcacaatctcagctcactgcagcctccgcctcccaggttcaagcaattctcctgccacagcctcccaagtagctgggatcataggcgtgcaccaccacgcctggctaatttttgtatttttagtagagacagggtttcaccatgttggccaggctggtcttgaactcctgacctcaggtgatccacccaccttggcctctcaaagtgctgggattacaggcatgagccactacacccagctgaaaagctacttttaaaaggaaatgtgttgagatttagaagcccgggtgtggtcttacagaggcttttctgcatgtacaacatatttccctgttttgaacttttggggcatgggatgggatgagggatggaagtatttacggtgtttcttagggatcaacaactatgaaaggaagtaggagaaaggtttgggcagagggagatgtggggtgcaatgcaggcccaataaagaagtggacaacttagccaggacccctggagcattattgcccatcaagctgaaaaggccctgcctttatactcaggtcttgatcaaacagtagatgtgggctaccccaggaagggtgatcttgggcaaggtggctctctgcagctgatatttggcacttttaaataccaaatgttttcctaaagcagtgatctcaatcattgtggcttcagaactcctatatttatttattcttattaattagagatggggtcttgctgtgttgcccaggctggcctcaaacttctggacccaagcctcccacatagctgggactacaggcatgtgccaccacacccagctctcagaatccctttatattaataaacattgaggaccccaagtagcttttgtatatgtgtatttgccacgttagaaaaaacaaattttgggtctaggtgtggtggctcacgcctgtaatcccagcactttgggaggccgaggcgggtatatcgcctgaggtcaggagtttcaagaccaaccttgccaacatactgaaaccctgtctctactaaaaatgcaaaaaattagctggatgtggtggcgggcgcctgtaattacagctactcgggaggctgaggcaggagaatcgcttgaacccaggtggcagagattgcattgagcca

SEQ ID NO: 1027 - DNA, 6238 bp, Homo Sapiens
actccagcaagaccctgtctcacaaaaaaaaaaaaaaaaaaaaaaaaaagcagcagaggcagtagctattcatcagataagacccattgtttggactgtttctaagtcacaattttggaccttaaaactctaatatctaccattgtctgctatttttttttttagggaggcaatgaaggtggggagagaattaagacttacgggccgggcgcagtggctcacgcctgtaattccagcagtttaggaggctgaggtgggtggatcacgaggtcaggagattgagaccatcctggctaacacggtgaaaccccatctctactaaaaatacaaaaaattagccgggcgtggtggcgggcacctgtaatcccaactacttgggaggctgaagcaggagaatggtgtgaacccaggaggcggagcttgcggtgagccgagatcgcaccactgcactccagcctgggcgacagagcgagactctgtctcaaaaaaaaaaaaaagacttaggaaatagcagatgaagcacaggcagaatttatccaggaaggtatggaatggggtttgggacatgagtcacaaaggggaaaccagattccttcagtgtgttaacttctctaaggaagctagaggacactggggcctgggaggtgtcctctaagccaagatctttcagaacaaaggttctatcttcaccacagagagcggtccggaaagggcagaggtgacctggcaaacttggagagaggggccttgtccttgtggctcctggtccagtgccagggtcttggggctcagaggctgtaagaagtggagccagtgagccctaggcatgtaagataatattttaagtgctcacttttccctgagcactctctgaacaccacagctattaaagataagcctcaatcccctagaggtcaccaggctctgaggaccaagcccagccctgcctctggaagcaggggggagagaggagcttgttggagaactctgggcaataagggctttggttggcagtgtcggagtgtgttgatgaagcaacagctgaacatcatacagtctacagtcagttggagaattaaaccaacacataaaggtgatggtgaaaaggacacagaaatgaggaggtgcactgagagaaggaaagatgaagcaggagatttcccagagctttggggagactttaaaggctttagggatccccaaagatcctacctctctcaccatccgtcaactctgctatgccctccctgagccacaccccctaagaggtacccacttctggatgggtttacttccaagagcagggactgcaggatttcaagggaaggcttggaaccatagtggccccattatctacctaggcatttgcagctggcaccatgccaaaaaagccctgtagaaagaggtcttattttcttccttcctcttcccctctggaaataaaagtaggttgtgtttctcctgcccgcccctagagatcagggaaacgggagctggaagggcatcttggattacctcgtcaaattctcactcagcatatcaatgcctgtgccttttgtcctggctactgccgcttcagtaaaggaggccaaaaccagttattgcggccagggcggctgcgaagtggttcaaagatcaacgactggggtcgtgtagggtgggcacgcagtccctggggcccaggggaaggggaatggtggtcggcgcccgggctcccttccctactggcaggagtgggggtgcacggaaggagggtaccaggagagccacaggttcccactggccacatgggaacagggtttggagaaggctctgcacagccacagtcggagcttcgtgctagggtcagaccgctctcgccatgggatcggtttgctcaccgagaaacttcaccgagaactgcaaatgggcatagaagattgcggagggggcagggacaggggccttggagaggcaagaggggaaccggtatcttccatctggtgcgcgtaaaccaagactctatcctgtgccgggtctctcctccccggtccaactcccttacttgtcctcatctctgtccccaaggtccgtgacccgcggaggtgatgggggggataggagagccccagggaccgcagaggtgacacaatcgcccgcccgtcctccctcgctgggagccgattcagcctgtgccgagcctctcccttcgcgcgcctctgcgcacagcggtggcaccgcaggactccgggtcccccccggctctccatcgggaagccggcaaatgcgcttcctcaggcagaccgcggcggggtgggggcggggggggggcggaagttgaaatactgggacagaaacacctgcccgtcccaagggacggaaaactggatgccaagggggccgcggcgcgcagcgggaggcgaggggagaccgggggtcgctgcgcaccgcccgcagccgaggggcgagcggcgacctcgcgcgccccagcgcggcctggccacggaggccggggcgcagggggcgccggcgggacttaccccagagcagagtgagtggcttggctttggggatgagcaccagggagtacacggcccccaagtggagcaagctcatcaggacgacattcctccagacgatgttctgccgctgcccgcgcgcgcctggcctctccgggccgccgccgccctcagagctttcgagcccggcacggatttcttccttggcgtcgcagaaagggatcttccccgcgtcggtggccgggcctggcatggctgggcgaggtgggcgcccgcagcagcggcaggcaggcaggcgctctgcccgagcggagctcgagggtgggggcgggggcttctgccttttaggggggaattctccgcacgtccagtcccctccttccagcccttctcccgggctcctgcgctcttccccagggtcttagcgtggcctagggatgcagatcttggcggccggcgtctgttgctggcgtatcccccatatggctgcccgggctgaactcggccgcgagaaagaggaggcgcgcgcggggcgggaggggcgcgcggccggggaggaggagctgtgaaaatggaacggggccggcgacgctggagggagcgctccgaaggagcgcggaagaaagccctgcttagctacagccaatcaggagcgcccgtgcggcgcttatagacaaaggcgcccccctttcggcttttcggggccgaactggggagcccgctgggcgggagttggccgcctccgcccgggggcgggtggaaggtggctcccggggcagggagcctgcagggcggctcacagcgcttctgctcttgtgtgtgtgtgacccccaaaatgccttttatggtatttttccagtcccccccccaaaaaaaaacttcccgaaactgtcatccctttgagaagccttttatttcttctcaagcctcaggccacctgggttggagaattttaaatacttgcttggagtcgcgaccctagttaaggccagacccacgatgagaatcagaagtccctcaatctgccagttagtagggctcctcgggccaggggagggttggaaggcagctgctcgttcttaattaggcagctgtggattacccaggcacacagtaagtgctcagttggtgcttgtgaggtgatgcacagatgatttgggccagttcgctgcccaccctttgcccatccgccgcgccactctgtttatggtcaattctagctaatcagcgcacttctgcaacgcctccttagctctcagtgaggaacactaccctgaaatcaacaccattgagaatcgggctttacaaaaaaatcacccagaatgttccaaggaaaattaacctgtgaaagatttgtgtctgcccacttctctcctagagctgatggcttaagagctctccagagaggaccctagttgcacagaaaatggagggaggattgagctggaagtgtctgaagcaggtgtgaccgcaattgcgggcaggcagcagaagtaaaagggctcgggacagcatctctgagttctagttttaactggctggaacccagcccaactctctgggcacggatttccttacctgagaagcagaactagtttctactcttccttccagcttccatattccatgaatgtgagttcgaaggggcgccattatattgaccaaaaccagctgatttttagattaaccgttgttaggaatcatttccaggatttcaagagaggcaaaaaaatttaaaagactgactgcatgaaagggccatgcataagcatcttattgttagcagacctgagccagtcctagcagccagacaaaacaatgcctgatttaagctaaagcaaggtatgtggcacttgtggaatctaggccactgagtcagtgttactgtgttgcttcagacggagctgaaattatagaatttgcctggagaccagataaatgtcggccctatataatgaccagtcagacagtggaacatgaagctggagggtgcgattttcatctgtctgttcaacctgggctatgtaatgaaccacgttttcttctcatgctccctctgctccccatacccagcagaccttcctactccctgtggctctctagttcagactgtcctttctctctggggtagactagttgctcggccaaaagcctctctccgggttattggaaaggctcaatgctgtaaagaccctcattctaaacattcagtcatttatttggcatttattgggcatctgctatgtgccaggaccagtgggcacaggggatccaaggatgaataaagtctggtcccgcccctaaaggagctcccatctagaagcaaagatggagcaaacaaatgtaacctcttgactatgaccttggaagggcagaaagttacagtccattatcggaaaaaaaaatttaattaggtatcaaacttacatacaaggagtctaagggaagcaaaaatagttccttattgtcccccctgagaaccttattaggtcagctgttctatcttgaatccatcttttgtttgtttgtttgtttttgtttttgagacggagtctcgctctgttgcccaggctggtgtgcagaggcctgatctcggctcactgcaagatctgcctcccgggttcacgccattctcctgcctcagcctcccgagtagctgggactacaggtgcccgccaccacgcccggctatttttttttttttttttttttttgtatttttagtagagacgggggtttcactgcgttagccaggatggtctcgatctcctgaccttgtgatccgccagccttggcctcccaaagtggtgggattgcaggcgtgagccactgtgcccggcccttgaatccatcttgaatgaacatctttctcttttccctcctgtgggtcagaccaggtatgaccagtcatttcagctggctgtcctcataatggagaagatgtttttgtgtgttgagggaggaaagaagtgttacttaggtttgtcagagcctgcctataaaaggattgttgaagaaaaatggtccttccaggtccagcctcagagtgaaacatctacaagatccaagatatattcttgctgataacgacggtcctctttagccaattatgccataggggtcactgcctcttttctctgtcttgccaaagaccctagtatattttcctagcttctagtcaggaccccaggagtggataagtattcacctgtcccaggatggggcaaatgggacagtaacccttatcctgtcaaacacgtaattaccaaaaatgtaataagagccataatggtggtatacgcaagataatgtagaggtgcaaaggagggagttgttaattcacacagaagcagggaggagggggagtgatacctggggaaggatttttaaaaaatatttaattgtggtaaaatacatgtaacataaaatgtatgtaacaaaatttaccactgtaaccgtttttaaatgtacagttcagtagtgttaactatatatgcacattactgtgcaaccgatctgcagaactttatcattttgcaaaactgaaactttatgctcattaaactcccctttcaatctccatccagatgctggcaaccactgtgctactttgtttcaattagtttgactactctagatacatcatataagtgaaataatagaggatttgtctttctgtgactggcttatttcacttagaatgttttcaaagctcatccaggttgtatgtgttagaattc

SEQ ID NO: 1028 - DNA, 4770 bp, Homo Sapiens
acagagcgcgaggtggatagtcccgtccattcaagagtcacactcagaccgagtgaaccatgattctgggttccacgttcctttgccctctgcaagggggcctgttgttcacgtgtctccggcccccaaaagcgtgaccatgttgactgtttcccgagctctgtggggacccagaaacctccagcgaagcgtggaaaagcagcatcctgtcttcgctctcctttccagtttccaaacaggccacagtggagacttcccttgttgcaggaaacaggaatccgtggtcaggccgtgatgcacgggacgtttcttttctctgtagtttcgctctcgttttctacatgaaaatgaacgagttccacaccactgcgtgtgtgagactatcacggcaacggcgacacccacaggcattgccgccttcacggagagggcatggaaaactcaagactgtcatggaagttcagttccacactccacccttcagggtggtttctgcctgaaaactgtgggagtcaagacagcggcttccagtttccatagaattactggagaaccttagagtgccagcccccgaagcccctttttcccctccaatctggccctacacccacccaccccacaaggccctggtccctgtggttttcggctttggagggcgggctaccccgggaccttgggccccgagttcatgcatgttcataacggggtggaggtggtaggtcttactaagggcctcctggctggacctgcctgcagcgcagaggccggctgaggtgcacgggagcccgccggcctctctccgcccgtgtccgtcggtgaaattccggccggggctccccgcgatggccctcccgacaccttcggacagcaccctccccgcggaagcccgaggacgaggacggcgaaggagactcgtttggaccccgagccaaagcgaggtcctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcctgcaagaaggcaggcgaaagcggaccgccgtcaccggatcccagaccgccctgctcctccgagcctttgagaaggatcgctttccaggcatcgccgccagggaagagctggccagagagacgggcctcccggagtccaggattcagatctggtttcagaatcgaagggccaggcacccgggacagggtggcagggcgcccgcgcacgcaggcggcctgtgcaacgcggcccccagcgggtgtcaccctgctccctcgtgggtcgcctgcgcccacaccggggcgtggggaacggggcttcccgcatcccacgtgccctgcgcgcctggggctctcccacagggggctttcgggagccagggagcgagggccgtccccgtgctccagcccagccaggccgcgccggcagaggggatctcccaacctgccccggcactcgggactttgtgttccctgccctagctcctccggaagtgggactgtcccaccctcagactcctcggaggcctccgcaccccagtaaatgacaggaggaccaggacccgcagcgcgacggcctgctgggcgcgtgctcagtgggacagcttgggccccctcaagctgagtcacaggggcaaggtgtgcttgcgccacccacgtcccaccggagtccgcggtggggctggagccccaggtcgccagggcggcgtgggaacccgaagacggggcacctccacctccgaagctcgcgaccccggaggcctctgcgtcaagcacagatgccagccatccaggcgcctcccaaccgctccaggagccggggcgctcgtctgcactcacctccagcctgttagatgagctcccgtcaaccccagactttcagcaaaaggcacaacctttcctagatccggtgtcactgggggagctgaaggaggtggaagagcctgctccgctggaaccactcctcagccaggaagaacacggggctctgctggaggagctttaggacgccgggttggggcggggcgggggcagggcggcggcctctctttggcggtgaacctctggctcggtatggagaggcgtgtcttcccttccagttgacctgtctaggatccctgggttccaggtccggcgagagactccacacagaggagggctgtcattctttcctgagcatcccggggatcccagggcccgtccacgtaccgggaggtggactgtctactgctcatgcgggggtttgcaggcaacagcttaggttttctaaccagcccaggcggagctcgcatcccttttccccccgcgttcttcagtcgggttggcggagacctcagtccgcgaaacactgggtcggggcagaagccaggccagttctcctttctgcggctcgattcctctgcctcttctctcactatcacttgccaacccgtgtcccaccagcctcctcgccagcaccatggagcgccttgcaactaaatgtagacccgagaccccgcgcaaaccggggtgctgccctttccaggcaagagggaaggcaggcagagatgaggacaggaacggagacagagtgggacggaaggatggagctaggaaaggatggatggacggagggaccctggaagggagaggaagagggagagagggagaaagggaggaaaaaaccagggcagggagggaagaacagagggcaggatggaccgagggacaaaaggagcaagaaacagagaaccgaaggcagacagaaaaacggtcttctgcctccagaaccaacaggacccagcaatccgggaaaatgttgggtgcccagtgcgggctaagtgctgggcccacagccccgttggccggtggggagctcagcggccctccggatcgccagcctgggttacttcatcccagagcgattcagacgaattccgtttccgaaggaatgagcgaattccccagagagcaatgagcggagactcgggtggttgtctgtttttcatccacatggttcacagatgacatatccccacgtttagccctgcaacagagcgcgaggcggatagtcccatccacacagaagtcacgctcaggccaagtgaagcgtgattctggattccacgtttctttgctctctgcaaaggtgcctgttactcaagtctctgccgcccccggaaagcgtgaccatgttgactgtttcccgagctctgtggggacccagaaacttccaggaatgcgtggaagaccagcatcgtgtcggtgctctcctttccagttttcaaacaggctatatcgaagactccccattttgcagaaaacaggaatccatcctcaggccgtgatgcacgggacgtttctttttctctgtgctttcgctctcattgtctacatgaaaatgaacgagatccacacacctgcgtgtgtgagactatcacggcaactatgacacccacgcgctggcaatagagttggcagcctgatcccaggacaaaggtactgacggacatccagacacaccccaccacaatcactagcaaacccactcccaaacagacacatacgggcgcacgcgcgggaacacaagcatacacgcagacacacaaagacacagacagcttgaagaagagcaagggacagagggatggagagatagaaacggaaggagagagagaaacagcgatagagagagagacagagagggacggggaaactgcgagagagagagagagagagagagagagagagagacagagagagagagagagacagagagggacggggaaactgcgagagagagggagagagagagagagagagagcaaggtggagagggaagtagagaaagggagagggtgagggagctagagagggggagcaacagagccttggagagggaggctctgctctggtagacaggggaccctttggcgagggtagggtggagggtgcctgggccgggctagaacaggagggcagggccgcccacgcgggaaaaccaacggagccctgagacgtgtttttacttggattggttggttgctttgggcgtgcgtttcctagcgtcattcctttgttggctcctccctgtcctcttggtgctgtgggccctgaaagttgtcgagtgcgcctgtccctgtggtgggagcagtggcgccgagcgtgcccacgggccgccgcttgggtttctctcgtgttcagggtagtatggacgtggacaatggcagtggcccctggctggcccaagagccgggtccagatacgcgcgcctgattccaggcgtcataaccaacccggggccgcgaggctgggatcaggcaccccggagccgcttgcccgtggccgggctgctctccccctctaagcctaagcaccgccagtcgcggcgctgcgctttccgccgacctcccagagcgtcccgccgtcgccggcggccagcctcgcgcaggaccagtgtggcgccgccctgctgttgctggggggcgcccgaggcctccattccttgcccaggcttccggctctcggggcggcctcccttccgcccacgctccagggcttccccggctcccgagctccgagcttccaccacatcggccggctcaggacaggtatgctcatcccgtcactttttaactttttgttgtttctatttatattttattgtgctatgtcttgaaatgttgttgtagctattact

SEQ ID NO: 1029 - DNA, 6308 bp, Artificial Sequence
  chemically treated genomic DNA (Homo sapiens)
ttatgaagagtatttatttgttatattatttagaattagttggtataaggggttatttttgaagataggtaaatttttttttttttgtttaaaatttaagaaatgttgtggtgaagagagatagtggagatagaaatgaaattaaatttgatgggtttgggtttaaatttagtttaattatttattagttgtgtgattttggtaaatttattttttttttttgagttttaggttagtgagtaattagtagggttataaggttcgtgacgtttaaagtagtttggttaagaatttgttgatttttttttttatttttttgtttttacgtagtatttttttatttatttaataaataaatatttatgtttggtatagtatgttgaatagatagttttttttttagaggaagtgataaaagtgattttttttagatggaaaaattgaggtttagaagttaagtggtttgtaagagttttgagatatttggatttttttgttattagttagaagagttttttattgaatttttgtttagttatattttatttttacggtttatttaagattttgggagtttttttcgggaattttttcggggttttattttaagcgagggtttaggaagggtgaattaagtcgtttggatttatggatttaataggtgtggggcggaaggtttttttttgtcgagggtgcggtttagcgttatttcgtttagttttagcgggatatttttatagttagtaggaagggtagtttaaaatttagtgttattttcgcgttttagttaagaaaataagggttatttaggtgtttttttagttgacgagatggaaaaattaaagtataatagataaagagggatcgttttaaaagaaaaaggggatttgaaaatattgtagattagggggaggaaaggaggtggaaagaaataatgttttatatataggaggggttttataaataatttgttgaaaagaaatcgttttgcggacgttataaagatgttttgtaggataagtttatttatatagaaaaaaagaaattttatttagggagttgttggtttttagagtttttattttttattttttaatttcgtggcgtgcgcgtttttcgttagattttagtttggggtttttttttggtttttagatttttcgttttttcggttgcgtttttcgtttggtttcgagggtaaatttgttttcgcggaatatattttcgcgagattgggttaaagttttggggtttgtatttttcgtaaaggagagttttcgagatcggaggtttattttaattttcgcgttcgagttcgggtttggagaaaagtgtttttttttcggtttcggtttcgttatcgcgggggattggcgggaggagtaggggaggtcggtgggatatttcgtattaggtcgtttatttataggggcgttcgggttaggggagtagacggagagcgggggcggtttttgattttttcgcgcgtcggggtcggggtcgggtcgggggttcggttcgtttagttaatgggcgtcgcgttcgggttttttttttcgtatcgggaggggtcgaggttgggttgttgttgtcgaggtcgtgtgcgacgtgtcgttttcgggttttgtgtttttagttttagtagggtcgcgtggacggcgcggcgttttcggaaggaggttatgtgtttagtgtcggcgttaattacgtacgcggcgtttttcggttcgttagattcgaagtttatttttattgcggttagcggttcggcggggcgttgcgttcgggattcgtatcgagttaggttcggagaggcgcgcggttcgtttcgggcgtatagcgtagcggggcggcgggggaggttttggtcggcgtaaggcgggtaggagtttgcgtttttgtttttggcgggagggttcgcgggcgcgcgatttattttgttgttgggttttatggtagcgttgcgttggtggttttggttgcgtcgggtacgcgggtggcgacgggcgtgcgagcggcgttttttcgtttaggttcgtgtttcggttcggggatttttattgcgattttgatttcgattttcgtcgtttggttttttgttttttggcgtgtttattcggggattcgcgattagcgatcggtacgttcgttgttgttattttttgttttttgttagagagcgcgcggatcgtagcgtttataggatttcggttattggttggcgacgtcggtgtgttaggggtgtgtgggtaggatttcggggcggggtttggggtttagtttgttttgggcggcgttttgcggggagggggtgaggggagtggtcggggtcggggttttttttaattattgtttcgtttaggttgtcgatcggttcgttttttttgcgttgggatcgcggagggtattcgttgtgtgatttagggtaagtgtgcgtatttttttgagttttcgcggttttttttagtaaaatggtggagtcggtattcggttgtaaggtaagttgggatgcgcggagtagcgggtggaaagttggattggagtttttattcggtcgttgggtgatttcggtgtattagggatagtaatagtattatttcgtagggttgtagaaagattaagtgagttaatatttgtaaagtgtttagaatagcgtttattgtatggaaagtagtatttatttgttagagagattttaggaggttttgtttagggattgattttttttttttttgtttttattttttatattttcgtttgtgagttaagttttgtttttgtatcggtcgggtttttttgtttggaaatgtatatttattttaaatttgggttttaaaattattttttttgggacgtttttttttattttttatagtttaggtgagtttatggtgatttgtaagtgtggaaaatatgaaaggtaggttaattgattgatatgataggatattaaggatatgatagatttcgggtttgaattagtttaattgtatattggttcggtcgcgattttgggcgagtttttggttagtgaggttgttttcgtttttttttttaattttttttttttttagatagagtttcgttttgtcgtttaggttggagtgtagcggtacgatttcggtttattgtaattttcgtttttcggatttaagtagttttttgttttagtttttcgagtagttgggattataggcgttcgttattatttttggttaattatttttatttttagtagagacggggttttattattttggttaggttggttttgaatttttgatttcgtgatttatttatttcgttttttaaagtattgggattataggcgtgagttattgagttcggtcgaggttgtttttttatgagtaaatggaatttttatattaattttattgttattaggagaggtgtaatttttagataagtttatgaagtgtttagtatggaagtttttatttattggttggtggtattgttggtttatttatttagtttgttagtaaataaataaatgttggttttaaatttttgggtttaagtgatttttttattttagttttcgtagtagttgggagtgtaggtatgtgttattgtattggtagtggtattgttattatttgattttattttattttttttagattagtgttttatttgagatatagtgaagggaaggatttttagtttaaaggtttgattaaagttttgagggtttttttttcgatggagggagttatggtgggtttattgtttgtcggaaatcgggaggttgagtcgattagatgatttttggagttttttggtaatgtgtttagttttggttgaggggtattttggttgagtatggagttttgaaatagaaggtaggtgtattttgggtatttttttgtttaaggttttaatttttgtggtttttttatgtttagtttggaaagtttgggttatttttttttttatttttggatagattaagttttgttgatttcgttgtttatattattttatttttttttttttttttgttgtttgtagggtttttattttttttggttttttgttttttagttttgtattttgttatttttttgtttatttgtttgaaattgttatggagggagtaagggttaagtttggttattacggtttttttttatggtattagtttatacgtttagtttcgttttttatattagtaatttatatttatatatttgtttagtttgttttttttgtttgggaagtttttttcgattttattatgttaaaaagtattatgggttttttttttttcgggaagtgtttttggtttttttaagtggaaattttttttttttttattatttggtgttttgtaggttgttatttgttttttgtttgtttttttttagtttgtgagtattttgaggataggttttgtagttgaggtacgtgggtgaatgattgaaggagggaaggaatgtacgaatgagtgagtagttaatttatttgtgttgaatgtttttttttttttagttcgttttgttgatatttttagtttttttttaagtattttttgggttttgttatttttttttttaaagtttttttatagttttttgttttttagtatatttagtttatgtttttttttagttgcgggtttgttttatttagtttatgggttatatttattaaatagttattttgtttttttttgggttagttttatgttggttatttttttagggatagagatatgtgattttattgttagttttatggaggttttaagttggaggaggagtaagaggggaaatgagtagtaataatattaagttaagcgtagagggttaagaatttgtataggtgtagaatttgtattataggggaaggagagtgagtagagagagtatttgggaagggggaggttatgttaagtagggtttggaagattgaataggagtttattagatggattgagggaaggttatttttagtagagagaagagtatgtgtaaaggtagtagattgttagaatgattatttagggaacgtgagaatttttgggttatttttagagatttatgatggagttttagattcggattttttgagttttagttttgttatttatttgtaaatatttatgggtaaataatgtttttttttttttgagtttgaagatttatatttgtaaaatagatataataaattttttttgggtaggtttgagggaaagtggatgtttataaaggtttagttatgtaaattgtatttatttttgacgtgagaagtttagttaaatttttattttatggtagggcggtgtttgaggaaaaagtatagtggttaaaaaaaagttttttttttatttattttattttatttgtttatatatagatttttattattttttttgtgtttttttttgtgaatgttttatgatttttggaggttattggttagaagtaaatttattagaagttattgacgttgtattatagattagatttttaggtggattggtttgttatttgggtggttgattttttggaagtagaatttaattttaattagggaatgagttttagagaaggttttaggaaatagtatatgagtagagaaggtttgggtgtaaggggaaaggggagtaggaggggtatttaagtagtttttgtggttggggtatgggggtttagggaggagaagagattgaagaagtggaattatagaggtttttaaatgttaggtataggagttagggttttatgtagtgggtagtggcgagttatggagagttattgagtagggaaaggatttgaggaaattttagtgtttttataagtttattttatttgaggtattaaagggggtgtgaggaggttgtggaattttagtatttagtttgaacgatttagtgttttttttttagtttgcgtttatattgatagttttattttttggaggttgtttttagttttggacggaattcggttttttttgggttcgattttaagtagttttagttttagttagtttggaggaaaagagttttttgggattggttagtagggaggtgttaggtgttaggcggatgttggagtttagtgtgtgttttagagtacgtaagtgggtgggggaggggtggtggtggtgatggtggtggtggtagggtcgtgtagggcgggttttagtagttttagagttaggagtgagtaaggcgggttgggaaaagattttgttgtttttaaaggtaagcgtttttggtagttaggaggaaaggttttgttgagttagttataattggtataagaggggatagtagg

SEQ ID NO: 1030 - DNA, 6308 bp, Artificial Sequence
  chemically treated genomic DNA (Homo sapiens)
tttgttatttttttttgtattaattgtagttgatttagtaaaatttttttttttggttgttagggacgtttgtttttaaaggtaatagagtttttttttagttcgttttatttatttttaattttggagttgttaggattcgttttgtacggttttgttattattattattattattattattttttttttatttatttgcgtgttttgaggtatatattaggttttagtattcgtttggtatttgatatttttttgttagttagttttagagagttttttttttttagattagttggggttggaattgtttagaatcggatttagaagaggtcgagtttcgtttaggattaaaggtagtttttagggaataaagttgttagtgtgggcgtagattagggaaggggtattaggtcgtttaagttgaatgttggggttttatagtttttttatattttttttagtgttttaggtagagtaggtttgtggggatattgaggtttttttaggttttttttttgtttaataattttttatggttcgttattatttattgtataaagttttaatttttatatttggtatttgggagtttttgtgattttatttttttagtttttttttttttttaagtttttatgttttagttataggggttatttaggtgttttttttgtttttttttttttttgtatttaaattttttttgtttatgtgttattttttggggttttttttagggtttattttttagttggagttaaattttgtttttaaggaattagttatttaaataataaattagtttatttgagaatttagtttgtgatgtagcgttaatagtttttgatgaatttgtttttgattagtagtttttaggggttataaaatatttatagagaggaatatagagaaggtaatgggggtttgtgtgtgggtaggtggggtggggtgggtgaaggaaaagtttttttttggttattgtgttttttttttaagtatcgttttattatgggatggggatttgattgaattttttacgttaagaatgagtatagtttatatagttaagtttttataaatatttatttttttttaggtttatttaggaagggtttgttatatttattttatagatgtgggtttttaggtttagagaagagaaggtattgtttgtttatgaatgtttgtaagtaaatagtagagttgggatttaaagagttcggatttggggttttattatgaatttttaagagtggtttagagatttttacgttttttaggtaattattttggtagtttgttgtttttgtatatgtttttttttttgttgagaatggtttttttttaatttatttggtgaatttttatttagttttttaaattttgtttagtatgatttttttttttttagatgttttttttatttatttttttttttttgtggtataagttttgtatttgtatagatttttaattttttacgtttgatttggtattgttgttgtttatttttttttttgttttttttttagtttggggtttttatgaggttaataatggggttatatgtttttgtttttgggaaagtggttagtatggggttggtttagagaaggataaggtggttgtttggtgagtgtgatttatgggttgagtaaggtagattcgtaattgggaaaaggtatagattggatgtgttaagaaataaggagttgtggagagattttgaggagggaagtagtaaaatttaaaaggtatttaaggaaagattggaagtattagtaggacggattggaggggaaggaatatttaatataggtagattagttgtttatttattcgtgtatttttttttttttttagttatttatttacgtgttttagttgtagaatttgtttttaaggtgtttataggttgagggaaggtagatagaggataagtggtaatttataaaatattaaatggtaaaggagagaaagatttttatttgggagaattagggatatttttcggaggaggaaggatttatggtgttttttggtatggtgaggtcggggagggttttttaggtagaggagataagttgagtaaatgtgtggatgtgagttgttggtgtgaggggcgaggttgagcgtgtaaattggtgttatgaagaaggatcgtgatggttaggtttggtttttattttttttatgataattttagatagatgagtaggagagtggtagggtgtaggattggaggataaaagattagaggagatggaggttttgtagatagtaggggagggaaggaggatgaggtggtgtagatagcggagttagtaggatttggtttgtttaggggtgaggagagaggtggtttaagttttttaggttgagtatagagagattataggaattgaagttttgggtaggggggtgtttagaatgtatttgttttttgttttagggttttatatttaattaaggtgttttttagttagaattggatatattgttagagaattttaggggttatttggtcggtttagtttttcggttttcgatagatagtaagtttattatgattttttttatcgggaaagggatttttaagattttgattagatttttggattgggggtttttttttttattgtgttttaagtaaggtattggtttagaggaaataaggtgaagttagatgatagtaatattattattagtgtagtggtatatgtttgtatttttagttattacggaggttaaggtgggaggattatttgagtttaggagtttgagattagtatttatttatttattaatagattaaataaataaattaataatattattaattagtaaatgagaatttttatgttaaatattttatgagtttatttggaaattgtattttttttgatagtaatgagattggtgtgggaattttatttatttataagaagatagtttcggtcgggtttagtggtttacgtttgtaattttagtattttgggaggcgaggtgggtggattacgaggttaagagtttaagattagtttggttaaaatggtgaaatttcgtttttattaaaaataaaaataattagttaggggtgatagcgggcgtttgtaattttagttattcgggaggttgaggtagagaattgtttgaattcgggaggcggaggttatagtgagtcgagatcgtgtcgttgtattttagtttgggcgatagagcgagattttgtttgagaaaaaaaaaaattaaagaaaaaaacgaaaatagttttattggttaggaattcgtttaggatcgcggtcgggttagtatatagttgagttggtttaaattcgaggtttattatgtttttaatgttttattatgttagttagttagtttgttttttatattttttatatttataggttattatagatttatttgaattgtgagaagtagaggaaggcgttttagaggaggtgattttaaagtttaggtttgagatgggtatgtatttttaggtaagagagttcggtcggtgtaaaagtaaggtttggtttataaacgggaatgtggggggtggagatagggaagggagaagttaatttttgggtaagattttttggagtttttttaataaataaatattattttttatgtagtagacgttgttttaaatattttataaatattaatttatttggtttttttataattttacgaggtggtattgttattatttttagtgtatcgaagttatttagcggtcgagtgagaattttagtttagttttttattcgttatttcgcgtattttagtttgttttatagtcgggtatcggttttattattttgttagagaaggtcgcggaggtttagagaggtgcgtatatttgttttgagttatatagcgaatgtttttcgcggttttaacgtagagagaacgagtcgatcggtagtttgagcgaggtagtggttagggggggtttcggtttcggttattttttttatttttttttcgtagagcgtcgtttaggataggttgggttttaggtttcgtttcgaggttttgtttatatatttttgatatatcggcgtcgttagttaatggtcggggttttataaacgttacggttcgcgcgttttttggtaagaggtaagaggtagtaatagcgagcgtgtcggtcgttagtcgcgggttttcgagtgagtacgttagggagtaggagattaaacgacgggggtcggagttagagtcgtagtgggagttttcggatcggagtacgagtttgagcgggagagcgtcgttcgtacgttcgtcgttattcgcgtattcggcgtagttagagttattagcgtagcgttgttatggagtttagtagtaaggtgagtcgcgcgttcgcgggttttttcgttaggaataaaggcgtagatttttgttcgttttacgtcggttagggtttttttcgtcgtttcgttgcgttgtgcgttcggggcgggtcgcgcgttttttcgagtttggttcggtgcgggtttcgagcgtagcgtttcgtcgggtcgttggtcgtagtggggatgggtttcggatttagcgggtcggagggcgtcgcgtgcgtagttggcgtcggtattgagtatatggttttttttcgggggcgtcgcgtcgtttacgcggttttgttggggttggggatatagggttcgggagcggtacgtcgtatacgatttcggtagtagtagtttagtttcggtttttttcggtgcgggggagggggttcgagcgcggcgtttattggttgagcgggtcgagttttcggttcggtttcggtttcggcgcgcggaggagttaggagtcgttttcgtttttcgtttgtttttttagttcggacgtttttgtaggtgggcggtttggtgcgaggtgttttatcggttttttttatttttttcgttagtttttcgcggtgacgaggtcgaggtcgaggggagggtatttttttttaggttcgggttcgaacgcgggggttgagatgaattttcggtttcggaggtttttttttgcgaggagtgtaggttttaaagttttggtttagtttcgcggagatgtgtttcgcggaggtaggtttattttcggggttaggcggggagcgtaatcggaggggcgggggatttgggggttaggaaagagttttaggttgaagtttagcgggaagcgcgtacgttacggggttggggaatgagggatggggattttggggattaataattttttagataggatttttttttttttgtgtaagtgggtttgttttgtagggtatttttgtagcgttcgtagagcgatttttttttaataaattgtttgtggagttttttttgtgtgtagggtattgtttttttttatttttttttttttttttagtttataatatttttaagtttttttttttttttgaaacggtttttttttatttattatattttgatttttttatttcgttagttgggagggtatttggatggtttttgtttttttagttgggacgcgggggtagtattgaattttgaattgttttttttattggttgtggaggtgtttcgttgagattgagcggggtggcgttgggtcgtattttcggtaggaaaaggtttttcgttttatatttgttgaatttataaatttagacgatttggtttattttttttgggttttcgtttgaggtgagatttcggggaagttttcggggaaggtttttaggattttaggtgagtcgtaagggtgggatataattaaataaaagtttagtgagaagtttttttagttagtggtaaggaagtttaaatattttagggtttttgtaggttatttaatttttgggttttagtttttttatttgaaagagattatttttgttattttttttagggaaggaattatttatttagtatattatgttagatatgggtatttatttgttgagtggataagggaatattacgtggagatagaaaagtggaggagaaaattagtaggtttttagttaaattattttaagcgttacggattttatagttttgttggttatttattagtttggagtttagagaagggaaataagtttgttaaagttatatagttagtaagtggttgaattggatttgaatttaggtttattagatttaattttatttttgtttttattgtttttttttattataatattttttgaattttgggtagaagggagagagtttgtttatttttaaaggtggttttttgtgttagttggttttaaatagtgtagtaggtgggtgttttttatgg

SEQ ID NO: 1031 - DNA, 6329 bp, Artificial Sequence
  chemically treated genomic DNA (Homo sapiens)
tatttgattgtgtttgttggtattttttttaagggtatagagttggggtttttgatttgatttttatgtatggatttttaggtggtattagaggagttatggagttagtaaagtttttaagagtttatgtaaaattttatttttgtgtatagggttttgatttttaggggttgtgaattaaggaaagttaaaaattattggtttagtgttatatataaaataggaatttattgaaggtgttcgtgatatttgttatttgaggtgtagaataaagggtgttatttatttaaagtaaaagtaaaatatgggttgggcgcggtggtttatgtttgtaattttagtagtttgggaggtcgaggttggtggattatttggggttaggagttcgagtatagtttggttaatatgatgaaatttcgtttgtattaaaaatataaaaattagtcgggcgtgatggcgcgcgtttgtaattttagttatttaggtggttgaggtaggggaattatttaaattcgggaggcggaggttgtagtgagtcgagatggcgttattgtattttagtttgggtaataagagcgaaattttatattcgtattttttatttattaaaaaaaaaaaagaaaagaataaaagaaaatgtgatatgatggttagaagttgtagttattaagggttagatcgtttattttttttattttttagtttagataaattaaaggagatttaagagagattttgtttaagattataaattatagagttattaagtggtaaagttgagtattaaagtttattggatttttattaggatgttagggtatgaaattatgtttatatttttttagaatgggtttgattaaaatttttttaatttttgtaaatattttattttattaagaaggtagttttttaaaattttattgtattttttttgagacggagttttgttttgttatttaggttggagtgtagtggtgtgatttcggtttatcgtaatttttattttttaggtttaagtaatttttttgttttagtttcgttagtagttgggattataggcgtgtgttattatatttgtttaatttttgtattttttagtagagacggggttttgttatgttggttaggttggtttcgaatttttaattttaggtgattcgtttattttcgttttttaaagtgttgggattataggcgtgagttattacgttcggtttagttttttaaaattttaaaattaagtttttatatagaatttgatatatttaaatattttttaaattattaattaagttacggattttttataaaagtcgtatatagattttttattttattttttttttgagacggagtttcgtattgtcgtttagtttggagtgtagtggtacgattttggtttattgaagtttttatttttttggtttaagagatttttttgttttagtttgttgagtagttgggattataggtatgcgttattacgttcggttaatttttgtatttttagtaaagattgggttttattatattggttagtttggttttgaatttttgattttatgatttattcgttttagttttttaaagtgttgggattataggagtgagttattacgcgtagtttagtatatagatttatgaggtgaattttagaggtttattattttttattttatgttatgaatataattttaagaagtaatataggggttaggtttatatttgtaattttagtattttgggcggtcgaggcgaatacgaggtcgattacgaggttaggagttcgagatcggtttggttaatatagtgaaattttatttttattaaaaatataaaaattagttggatatggtgatgggcgtttataattttagttattcgggaggttgaagtaggagaatcgtttgaatcggggaggcggaggttgtagtgagttaagattgcgttattgtattttagtttgagtgatagaggtagatttcgtttgaaaaaaaaaaacgtagtataggttataagtttattgagtgaggtatttttaaatgtattagggaagatagttattgatagttgatttcggggtggatttgtataattttaatttgtaagttgtaggatttttttaagttttttttttatgttaatattaatagcgttgtttaaatattaaatgttttttttttaatttaggtaatggggttatttataaattaaattgagaataatttttttagttttatgtttataaatattatatgtagtagaattaaagatattaggtaattattttgagattagattaaaaaataattattgttataaaaaagttatagaattatttgttttaatgttaaattttgttttagtatatgaaatttaaagtaattaaaaatttagttttatttgggaagggaaattaaagtgatatttgaatttaagtttaatgataatacgttttttaattttaaagcgagcgtattgttttatttatttaaagagttttaacggtataatattttatagtatatataaaattttttaaggcgtatattatggtaaagtttttgattgtttgtgaattatatttagttttttttgttagtttttttcgtagttttttatttttaaaaggtataattggaataggttttagggagtatttgtggtttgaaaaggttgtgattaatttttagagttttatcggttgtaatttataagtaggttcgattattttattttggattaaggagattttgttaatttttaagtgatcgtaagtggataagattaatttgggagaaaacgttgtgagggttttttcgttaagttagtagtttttatcgttatatttcgaaaagggtgaagatttggttattatttaggcggcgaaagaatacggtcgggttgtttgggggtttacgattgtttgtcggtcggcgatttcgtagtttgggtcgggttgtggtgtcgggagtacgcgaagaggtagggattttcggggtatgcggagagggaattagaacgaggttaggagtttgtaggtgtcgtttagggaggggacgaggtcgtttagggttggtacggtcgagtgagatcgagagtgtggttttggattcggatagatcggttatattttcgggttgtgattttgagtatacgatttgatcgttgtgcgttttagtttttttttttttaaaatgggggtcgtttaagcggaaaacgcgtttcggagcgtttggtacggcgtttggcgtatagtaagcgttttttttatgtgagcgttttggtttttttcgtcgtcgggaggaattggggaagtttcgcgcggggagttttcgggaggcggattcgaggttggggtaagggaatcgggtcggggatttatcgagtacgttcgcggaacggtgtcgggttacgaagtacgcgtcgttttcgtagtacgcgttttttttgaggaggtttttacggaagtttttttcgaagtcgtagtcggtcgttattagttcgtagtcgtcgtcgtcgtcgtcgtcggttttggggtcggtttgcgagaggtcgtcgagtacggcgcgggttattagtcgttcgtacgagaggatcgagaatatcgtcgtcgtcgttttttcgaggaggcggggggtcgggggagtaggaggacgcggaggttcggagtcggttttttttttagtcgtagtcgcgtcgtcgttggggcgttttttagggcggcgcgtagtggtcgtcgtcgtttttgttcgacgcgcggggtttcgtacgcgtttagtcgcgcgtatcggagttagagcgaggttagaagcggcggttttttcgttttagtttaattgaagtttcggttgtagcggtcgtcgtcgtcgtcgttatttttcgttttattagcgtgtttcgggcggtgtcggtagtatcgttttttttttggttttgtttttagtttcgtttcgatttatcgtttaggtttaagtttagttttttgggttcgttgttttatgtagttattaaggttgaatatgcgtagagggtgcggacgtagtgttttttgggaattatagtttcggagtcgtagttatttttgatttggttgttaaagatttaggatttagggggattttttagacgcgggatttatgttaagttagtaggaattgtaggtgggttacgtgagggttttttattttgttttaatcgtattttttaaagtttgttttaaataaataacgttattatttttttaaataaaaatttgtaagaaattagaatggagttatataatgagaaatagaggtatatagatttagtgatatttttttaagtaatatattggaaggatttagggcggtaaattgtttggaaagaagagattttttgtagttttttaggaaaaattgagaaaatgttatgtgtttttattagagtgggaggggatatagatggtgttatgttttttttgttaattggtttttagttatgtttatagttgttttaagatttttgtttttgttttcgtttttattttttggaatgtaattcgtttatttgagggttttgtgttttttgttgttgtatttttagaatacgtgagtatttagtaaatatgtgaatgaatgaaagaatgaatgaatattttattagattttaagttttttaaggataaggattatttgttgtttaattattagaatttaaagtaatgtttggtatatagtaggagagtgtgtaaatgtttgtggaataaaagaaggaataatgggttgggcgtggtggtttatatttgtaattttagtattttggaaggtcgaggtgggtagattatttgaggttaggagtttaatattagtttggttaatatggtttttattgaaaatataaaaaaaaattagttgggtttggtgataaacgattgtaatgttagttatttaggaggttgagataggagaatcgtttgaatttgggaggtagaggttgtagtgagtcgagatagcgttattgtattttagtttgggagatagagttggattttattttaaaaaaaaaaaaaggaaggagtaatggaataagaatataaatgataaaagaaagttatgtttgttgaatataggaatgattgagtgaatggggtttataaataatagaaaatgagttttggggtaagtaatttaatttagagtaatttttagtttgattgaaatatatattttttagaaatagtagtttttttttagtttatttttaataagattattgttattttggggatttttatttcgtttttaaatggtttttttttatgtttttttaatatatttaaaatgttgttaattattaatttaatatatattatttcgttattttaattattgttattattaaatatttttgtagtttatagtgtgttaagtattgtttatatatatgtttttgtttttaagagtttttattaaaattggacggaagaaatgattttacgtagtggtattttgttaaatatatagaatttagaaaatgtttatttattggataaatggtatagtaatgataataatgtatttatattttttttttttttaatggtataagaattggagagtgtttagaagagggggtagtgtttttcggaattttttatttggtatttatattgttgttagttgtgttaaaggtagtttttttaagtatatatattattattagattttagttagtttggtaggtaattttattttaaggataaattttttaaaatagtatgttaattttattttttgtttcgttaaatttttttagattgtttttattttttttttttagggtatatattatttaatttttatgttagttataagaattggtttgatgggatgagtaggaatttaaaatgtgattttaaagttagtaatttttgtttcgatggggttgttgtttttatgattaagtgatattagtgttttgagttttcggtaaatgaattttttgtaagtgagttttttgtaaatgagttgtttatagaagtacgtggcgaatagaattttttttaaagtttttttgtaagttttaaaggaataggagatagggtttcgggtttttttgaattatttattttagagttagttttgaagttttattattatgggggaagttaggagagggtattttataaaatattttttttttcgtttttttttttaggaatataatttacgtttgatattttgttggatttaaaaaggtttggatttttttttttaatagagttatatttttagtattttagggatttttgagaggttagttgttatttttaaaggtgaataagtgtg

SEQ ID NO: 1032 - DNA, 6329 bp, Artificial Sequence
  chemically treated genomic DNA (Homo sapiens)
tatatttgtttatttttaagagtggtaattgattttttaggaatttttgaagtgttaggaatgtaattttgttaaggaagaaaatttaggtttttttaagtttaataaaatgttaaacgtgaattgtgtttttgggagaaggaacgggaagggaggtgttttgtaaagtatttttttttggttttttttatggtgatgaaattttagagttggttttggaataaatgatttaagagaattcgaggttttattttttgtttttttaaaatttgtaaaggagttttgagaaggattttgttcgttacgtgtttttgtgggtaatttatttgtaggaaatttatttgtaggaaatttatttgtcggaaatttaaggtattggtattatttaattatgaaaatagtagttttatcggagtagaagttattggttttagagttatattttaggtttttatttattttattaaattagtttttgtgattgatatggaaattaggtaatatatgttttgaaaaggaaaagtaggagtagtttgaaggagtttgacgaggtaagaaatagggttgatatgttattttaaaaagtttgtttttggggtagaattatttgttagattgattgggatttggtagtggtatgtgtatttgaaagagttatttttagtatagttggtagtaatataaatgttaagtagaggatttcgagaggtattatttttttttttgggtattttttaatttttgtgttattaaaaaaaaggaaggtgtgaatgtattattgttattattatattatttatttagtaaatgaatattttttgggttttgtatatttgataaaatgttattacgtgaagttatttttttcgtttaattttgatgaaagtttttaaagatagaaatatatatatagatagtatttggtatattgtgaattgtaaaagtgtttaatgatgatagtaattaggataacggaataatatgtgttgagttgatagttggtagtattttaaatatattaagaaagtataaaaaaggattatttaaaaacgaggtgggaatttttaaagtaataatggttttgttaaaagtgaattagaaaaagattgttgtttttgagaaatatatgttttaattaaattaaaaattattttaaattgaattatttgttttaaagtttattttttgttgtttgtgaattttatttatttaattatttttgtatttaataaatatgatttttttttattatttgtgtttttattttattatttttttttttttttttttttgagatggagtttagttttgttttttaggttggaatgtagtggcgttgtttcggtttattgtaatttttgttttttaggtttaagcgatttttttgttttagttttttgagtagttggtattataatcgtttgttattaagtttagttaatttttttttgtatttttagtagagattatgttggttaggttggtgttgaatttttgattttaagtgatttgtttatttcggttttttaaagtgttgggattataggtgtgagttattacgtttagtttattatttttttttttattttatagatatttatatatttttttattgtgtgttaggtattgttttagattttaataattgagtagtaaatgatttttgtttttgggaaatttagaatttagtgaaatatttatttatttttttatttatttatatatttattgggtgtttacgtgttttggggatatagtaatagaaaatataggatttttaggtaaacgaattatattttaaagggtagaagcgaaagtaagggtaaaggttttgagatagttgtgagtatggttagaggttagttagtaaaagggatatgatattatttgtgtttttttttattttgatagggatatataatatttttttaattttttttaaaagattataaaaagttttttttttttaaatagtttgtcgttttaaatttttttagtatattatttggggaggtgttattagatttgtgtatttttgttttttattatgtgattttattttggttttttgtaggtttttgtttaaaggaatggtggcgttatttatttaaaataggttttaaaagatacggttaaaatagggtagaaaatttttacgtggtttatttgtaatttttattaatttaatataggtttcgcgtttgaggaatttttttaggttttaaatttttggtagttaagttaaaagtgattacgatttcgggattataatttttaagagatattgcgttcgtattttttgcgtatgtttaattttggtgattgtataaggtagcgagtttaaggggttgggtttgggtttgagcggtgaatcggggcggggttaggggtagggttagggagggggcggtgttgtcggtatcgttcggaatacgttagtggagcggaagatggcggcggcggcggcggtcgttgtagtcgggattttagttgggttgaggcggaggagtcgtcgtttttgatttcgttttggtttcggtgcgcgcggttgagcgcgtgcgaggtttcgcgcgtcgggtaggggcggcggcggttattgcgcgtcgttttgaggagcgttttagcggcggcgcgattgcggttgaggagagagtcggtttcgggttttcgcgtttttttgttttttcggtttttcgttttttcgggggggcggcggcggcgatgttttcggttttttcgtacgggcggttggtggttcgcgtcgtgttcggcggtttttcgtagatcgattttagggtcggcggcggcggcggcggcgattacggattggtgacggtcggttgcggtttcgggaaggattttcgtaagggtttttttaagaagggcgcgtgttacggggacgacgcgtgtttcgtggttcggtatcgtttcgcggacgtgttcggtgagttttcgattcggtttttttgttttagtttcggattcgtttttcggggatttttcgcgcggggtttttttagtttttttcggcggcgaaaggagttagagcgtttatatggagggagcgtttattatgcgttaggcgtcgtgttaagcgtttcgaggcgcgtttttcgtttgaacgatttttattttagagaggaggaaattaaggcgtatagcggttaagtcgtgtgtttaaggttataattcgagagtgtgatcggtttgttcgagtttagagttatattttcggttttattcggtcgtgttagttttgggcgatttcgttttttttttgggcgatatttgtaggtttttaatttcgttttggtttttttttcgtatgtttcggggatttttgttttttcgcgtgttttcgatattatagttcggtttaggttgcgggatcgtcggtcgataggtagtcgtgagtttttagatagttcggtcgtattttttcgtcgtttggatggtaattaaatttttatttttttcggagtgtggcggtgggggttgttggtttggcgaaaaaatttttatagcgtttttttttaaattgattttgtttatttgcggttatttgggggttggtagagtttttttgatttaaaatagaatggtcgagtttatttgtagattgtagtcggtaaagttttgaggattggttatagtttttttaggttataggtgttttttgaggtttattttagttatattttttgggggtgggagattacggagagagttggtagaaagggttaaatatagtttataagtagttagaaattttattataatgtacgttttaggagattttgtgtatgttatgggatattgtgtcgttaaaattttttgaatgaataaagtaatgcgttcgttttgaaattgaaggacgtgttgttattgaatttgggtttaaatgttattttgatttttttttttaggtgagattaagtttttggttattttaaattttatatgttgaggtagagtttggtattggaataaatgattttgtaatttttttatgatagtaattattttttaatttgattttagaataattgtttagtatttttggttttattatatgtagtgtttgtgaatatgggattggaaaggttgtttttagtttaatttatgaatgattttattatttgggttgaagaaaaagtatttaatgtttaggtaacgttattgatattaatatgagagggagatttagaaaggttttgtagtttgtagattgaaattgtataaatttatttcgaagttagttgttagtggttgttttttttgatatatttagaagtgttttatttaatgagtttgtgatttgtgttgcgttttttttttttagacggagtttatttttgttatttaggttggagtgtagtggcgtaattttggtttattgtagttttcgttttttcggtttaagcgatttttttgttttagtttttcgagtagttgggattataggcgtttattattatgtttagttaatttttgtatttttagtagagatggggttttattgtgttggttaggtcggtttcgaatttttgatttcgtgatcggtttcgtgttcgtttcggtcgtttaaggtgttgggattataagtgtgagtttggtttttgtgttgttttttaaagttgtgtttataatataggataggggataatgagtttttaaggtttattttataaatttgtatgttgggttgcgcgtggtggtttatttttataattttagtattttgggaggttgaggcgggtggattatgaggttaagagtttaagattagattgattaatatggtgaaatttagtttttattaaaaatataaaaattagtcgggcgtgatggcgtatgtttatagttttagttatttaataggttgaggtaggagaattttttgaattagggaggtggaggttttagtgagttaagatcgtgttattgtattttagattgggcgatagtgcgagatttcgttttaaaaaaaaaataaaataaaaaatttgtatgcgatttttgtgaaagattcgtgatttgattgatgatttggggagtatttaaatgtattaaattttatatggaagtttgattttaaaattttggaaggttagatcgggcgtggtggtttacgtttgtaattttagtattttgggaggcggaggtgggcggattatttgaggttaggagttcgagattagtttggttaatatggtaaaatttcgtttttattaaaaaatataaaaattaggtaggtgtggtggtatacgtttgtagttttagttattagcgaggttgaggtaggagaattgtttgaatttgggagatggaggttgcggtgagtcgagattatattattgtattttagtttgggtaatagagtaagatttcgttttaaaaaaaatataataaaattttggaaggttatttttttaatggagtgggatatttataagaattggggggattttggttaaatttattttaaaaaagtataaatataattttatgttttgatattttggtggaaatttagtgaattttgatgtttagttttgttatttagtagttttgtgatttgtggttttgggtagagttttttttgagttttttttggtttatttggattaggggataaagggaatggacgatttgatttttagtgattatagtttttgattattatattatatttttttttgttttttttttttttttttttggtgggtggggggtgcgggtatggagtttcgtttttgttgtttaggttggagtgtaatggcgttatttcggtttattgtaattttcgtttttcgggtttaagtgatttttttgttttagttatttgagtagttgggattataggcgcgcgttattacgttcggttaatttttgtatttttagtataaacggggttttattatgttggttaggttgtattcgaatttttaattttaggtgatttattagtttcggttttttaaattgttgggattataggtatgaattatcgcgtttagtttatattttatttttgttttgaatagatggtattttttgttttgtattttaaatgataggtgttacgggtatttttagtagatttttgttttgtatgtagtattaaattagtggtttttagttttttttgatttataatttttgaggattaggattttgtgtatagagataaaattttgtatgggtttttaggaattttgttgattttatgatttttttgatattatttggaggtttatgtataggaattagattaagaattttagttttgtatttttgaagggaatgttagtagatatagttagata

SEQ ID NO: 1033 - DNA, 6288 bp, Artificial Sequence
  chemically treated genomic DNA (Homo sapiens)
tttgagtaagagtttaaaagaattgatagattgataaaaagttttaagtagtttagaggattgagtattaaaatttagaataatgtaataaaagtatagaagataaagttaaaatgttttatatgatagtagaatatttaggttaagttggaggattggggagaataagtgaagaaggtaagttttggttagataataggtggtttttagtgttaggatgaggatttggaagttaattttttggttagtggataataaatgatggtatttgtgtagttgagttagttgataatgttttaataattttaaaaggttttgaaaaatatggtttttaatttttaagaaaaaaggaatttttgattttaggattttaagttaggaggaaattggataaatttttttatggtttaattgtatagaaaatagattatttcggtcgttttatttattgagtaattttttttattagagaatgtgttatatatgatttttttatttttaacggaaattttggatttttagttatttttttttgattttttgtttggtgattagaaaaagatgattaaattgggaatttttattttttagtggaaaaaaaaaattatgtatatcgtattttatattttttaattgggtgtaaatttgaattttaatattataaaaattagtaaaatttattttaagtataaagttgttaatttttttaagatttattaagaatggtttaattttaaaggttgttaagttaattataagttaagattttttagttgtattaagggtatattttatttggtaaaagaaatatttattggtttttgttaggatgagttttgagttatttaagttttgaattgagaggtttttagaaatttattttatatattaattgtggttttttttatattataaatttttttttatttatttttaaattgtttttttttttaggatatttgtgatataaagattgtgatatatttataggtcgattaatatgaggatttaatatttattaaaatatttatatttttgagaatattaaaaattaattatttcgttaggttttatttttagtttagttgaattaggaaattttaggagaagtatttggaagtaggtttaataagcgtaaaggtgatttttataattgggaaagtttggaattaagatagggtttttgttttggaggaagtatttttttgtggagaaggatttgtaaatagtttatgaagtgtttagtttttattaagaaaagaaaaatatgggttgatagggttaaggaaacgtttgattgaagaggattaaattttgaaggttagggatgtttttgggcgttggggttttttaattattaaagatcgatattataggttaggtagttttttgtttttttagaggattgttttgtgttttatgtttagtatttttggtttttgtttattggatatttttagtatttttttcgtaatatatatatatttgataatttaaaatatttatagatattgttaaatattttatagggggtggggtggtggtaatatatttttttgtttgaagttattggaatggaagttaggggaggatggttaagttaggatttgtaaaaaggttaagggacgaaagtatatggttatattagataaagtttgtgatagacgtttgtaggtatatggtaaggaaaatagattaaaatattaagaaatagtaagaggtcggatcgagggttttttatttgtatgggaaattttatttcgtttattatttttagaaataaaaaggaaaacgattttaaagatataggttaaaggtcgaaggggtgtagaattatttttcgtttttttttttttattttttttaaatattttagaacgagttaaatttttcgaatttcgtagtatagataataagtaatttagtaagattggacggggatgattgagggttaatttattataggattataggaaattttttagttttaaattcgaatgtattcgtgattatggtaatattttttatttgattaaaagttattaaacgttttgataagtgtttatagttgttttttcgattattgaagtggttttgaaaagagtttttggggttaggtggttgatttattgcgttttttgtatatttttatttcgagttggtgtatttggtgatcgttttggtgttttcggatacggcgtgtttggttagttcgtcgggtagtagtaggcgtacggtcgtttggatttcgcgggatgtgatggtggagcgtttgttgtagtgcgttaggcgggacgtttttttcgcgatgcgttcgaagatgtcgttgacgaaggagtttatgatgtttatggttttggacgagatgtcggtgtcggggtggatttgttttagtattttgtatacgtaaacggagtagttttttttgcggttgcgtttgcgttttttgtcgttttttttttgtattttcgtaatagtttttttggagttttttttgggagtaggagcggatttcgttggattcggtatttttgcgcgaaaaaagagaaaagagatttaaagaagtaattcgaattatcgtaaaacgggttggttatgcgttatttatagagttcgtatgtaaatgaagattcgtaaagtgttgcgtttttattggttaatttataacggtgtcgttagagggggtggagtttatgtaaataatagattttagttttgtttttttaatggttattgtaataaaagttttgttattttattagaatggtttattttatattaattagttttaagttaggtgaagcgatagtttttacggtttggggtttttttttggtttttattttttattagatttgtatacggaagaaattttaacgttagttagataagttaatttttttgtttcgtttttgtatttttattttatattttgtggaaattttttttttttttttgaaatattattttatttatttttaaaaatcgttagatatttattttcgttcgtttaaattattattttggtttggatatcgtttgtagtatgtaatgaggaagatgttgagttttaattaagtttatagtttttaaataaattaggaaacgggtttataatttttaagggattcgttttatttttatatttaggattttttatatttagaaattttttatagttttttgtttttatgtaaaattttatttatagaattgggagtcggatttttagttttaaattagcgtgaaaacgttcggtcggaattataaggattatgtttttgcggttttttttattgtcggttaatttacggttgggttttgggttttgtaacgttatttattacgagtgtttttggtttttgatcgttgcgtaaggtagacgtatattagatggagagtcggtatagttgtttttgatgaaaacggtagtggttttgaaaagagtttttagatcgattatttaaaaatatgttttaggttcgtttttcgcggatgcggcgggttaattggatgtttttgggtatgatggttacgcgtttggtatggatggcgtataggttcgtgttttcgaatagttttattaggtaggtttcgttggttttttgtagcgttattacggtcgagttttggaagcgtaggttcgttttaaagttttgcgcgatttcgcgtattagtcgttggaagggtagtttgcggattagtagtttcgtagatttttggtagcgtcggatttttcgtagagttacggtgtcgggtcggtagcggtgcggtttttttatttcgttcgtggtcggcgcgtttttgcgggtcgttttggtagttagttgttttttcggggttttgtcgtcggtcgatttgcgggtagtttgtttagtacgggttatgttgttttattgataggagagggtttaggtagttatatttatagatatagtttttttttgattgggtttgaaaaggaaatttttaaatttgtgattttattggttaaaatttaattttttttattggggcggaagattgttttgttaatttttttttttttattattttttttttttttgatttttttttgtaattttatcgattacggattgtttttgaagatttttttttaaattagtttaatttttgtaaaagtaatgtataaagtgttttgtattttattttaatagagatttttttttttttcgaatttaagtatgtttttttatgagttattagtttgttttaggttatttgttattgtagtttttttattatagttaatatttattttatgtttggtattttgtttagtaagttagatgtattgtatattatgaatgatcgaagtttagtaaaaaaatatgtaattgaaggaatgaaaaaattgattttatttatttgattttggaatttagttaaagttattttatgtgggtagtgtgttgatttatattgatttgatattagagtttttgtttttttttagttttttttttttgcgatgtggtttttttttttttaattttatattaatggttaattaggttttgtagatgttaagtttttaaattaaagaaggataatattagaaatttattttttttttataatgtagaatagtttgtaaattagtgtttattagttagattataagtttaagttttaaagtaaattatttattaattgttgatttgttaatattttatttaataaagtattttataatgtttaaaagtttagttttttttttgttttttatgaagagagtaaagatgttttgtttttttaattttatgtgttttgaagtatgtattgtttagaatagtaaatattatagtggttatgtagaagtaattgatatttaaaagttgtagtagttaatataaaatttttaattatatttttattttattaaaaaaattattataaattataaaaatttaaatttgagaaaagtaggttcgaaacgtttaaaatttattttgatggtgttattatgaattatttttttattgaagttaaagtaaagtaaaagtgattttaaggggattttttgaatattaaatataaagtagaaatttgtgagtttaattaatatttttaagagttttttatgggtagaagtatttttttttcgagagatttaaaatgtataaaagtgtaattgatgtgaataaatgttatttttttttgtggtagttttgtaataatgttttatagatagtaggtattatttagtgtttaaagtttttttatatatattttattatttaatttttattttgtgaaatagatgttattttttttattttatagataagaaaattgagttttagagaaattatggtttgttttgggtaagtaataaagtttgtgtaatattttaaagtaaaagaatgaaattgtaatgatgaaattttttattttattaggtttagaggatattttttttttttttttttatttgagatggagttttattttgttatttaggttggagtgtagtggtaggatttttgtttattgtagtttttgttttttgtgtttaagtaatttttttgttttagttttttgagtagttgggattataggcgtaagttattatttttagttaatttatttatttatttgtatttttagtagagatacggttttattatattggttaggttggtttcgaatttttgattttaggtgatttatttttttcggttttttaaagtgtttgggttgtaggtatgagttttacgtatttagttaatatagtttaaagtataaaagcgtttttttattaagtaattatattatttagtattttttaaatatttatatttaattatttttattagaagggaaaattattttatggaatttggatgatagtttaaagtagtttatttaagtattatatttttttgtaatatattttttttatgatgtatgtagttttgattataatgtaggatgtgtttatttaaataagaaaatggtatttaattagattttaatggttataggtattattttttagaataaaataattagatgtatagttgttttaaaagttatttttaataatagaatttagattaattgttagtttaattttatttagtttttatattggatattagagtgatatttttgtgaaaggttttaatttattattatattagaagtaattttatggtgtaaaagaagttttgtttttttttagttgtaataaagacggaatattttttttaaaatttttgaagtgttttttagtagaaattataaggttgtgtagtttgaata

SEQ ID NO: 1034 - DNA, 6288 bp, Artificial Sequence
  chemically treated genomic DNA (Homo sapiens)
tatttaagttgtatagttttataatttttgttgaaggatattttaaaaattttaggaggaatatttcgtttttgttataattgaagaaaagtagagttttttttgtattataaagttgtttttgatatagtggtggattgagattttttatagaaatgttattttagtgtttaatgtggggattaggtgaaattgaattaataattgatttgaattttgttattaaagatgatttttaaggtaattatatatttgattgttttattttgagaaatgatatttatagttattaaagtttgattgaatgttatttttttatttaaatgaatatattttatattatggttaagattgtatatattatagagaaagtatattgtaaagaaatgtgatgtttgggtgggttgttttgggttattatttagattttatggggtagtttttttttttaatgggaatagttgggtgtagatgtttgagaaatattagatgatgtgattgtttgatgggaaaacgtttttgtgttttaaattgtgttggttgggtgcgtggggtttatgtttgtaatttaagtattttgggaggtcgaggagggtggattatttgaggttaggagttcgagattagtttgattaatatggtgaaatcgtgtttttattaaaaatataaataaataaataaattagttgggggtggtggtttgcgtttatagttttagttgtttaggaggttgagataggagaattgtttgaatataggaggtagaggttgtagtgagtagagattttattattgtattttagtttgggtgatagagtgagattttattttaaatgaaaaaaaaaaaaaaaggtattttttaagtttaatgaaatagaaagttttattattatagttttatttttttgttttagaatattatataggttttgttatttatttaggataagttataatttttttgagatttagtttttttatttgtaaagtgagaagagtaatatttattttatagagtagggattaaatgataaagtgtatgtagaagaattttaaatattgagtagtgtttgttgtttgtaaggtattattataaaattattatagagagggataatatttgtttatattagttatatttttgtatattttagatttttcgagaggaggatgtttttgtttatgagagatttttgaagatattaattaagtttatagatttttattttgtgtttagtgtttaggaagtttttttgaaattatttttattttattttgattttagtaggaagatagtttataatgatattattaaagtaagttttaagcgtttcgggtttgttttttttaggtttgagtttttatagtttgtaatgatttttttagtaaaataaggatatgattaaaagttttatattaattattataatttttaagtattagttgtttttatataattattatgatatttattgttttgaataatatatattttaaagtatatgaaattgaaaaagtaaagtatttttattttttttatagagaatagaaaaaaaattaaatttttaagtattataaaatattttattgaataaaatgttagtaagttagtaattgatgaataatttgttttgaaatttgaatttgtaatttggttaataagtattaatttataaattattttatattgtaaaggagaaatgaatttttggtgttgtttttttttgatttagaagtttaatatttgtaggatttaattggttattgatgtgaggttgaggaagaaggaattatatcgtagggagaaaagattaaaggaaggtagaggttttaatattaggttaatataggttagtatattatttatatgaaatggttttggttgggttttaaggttaagtaaataagattaatttttttatttttttaattatatatttttttgttaagtttcggttatttatggtatataatgtatttaatttgttgagtaaaatgttagatatgaaataaatgttagttatggtagaagagttatagtaataggtaatttgaaataggttgatagtttatagaagggtatgtttgaattcggggaaaaaaaaaatttttgttaaaatgggatgtaaaatattttatatattgtttttataaaagttagattaatttaaaggaaagtttttaaaaataattcgtgatcgataaaattatagaaaaaaattaggaaagggggaaataataagggaagaaagattagtagaataatttttcgttttagtaaagaggattgaattttaattaatgagattataagtttgaaaattttttttttaggtttaattaagaggagattatgtttataaatatgattgtttagatttttttttattaatgagatagtatggttcgtattaagtagattgttcgtaagtcgatcggcggtaaggtttcgaggaagtagttggttattaaagcggttcgtaagagcgcgtcggttacgggcggggtgaagaagtcgtatcgttatcggttcggtatcgtggttttgcgggagattcggcgttattagaagtttacggagttgttgattcgtaagttgtttttttagcggttggtacgcgagatcgcgtaggattttaagacggatttgcgtttttagagttcggtcgtgatggcgttgtaggaggttagcgaggtttatttggtggggttgttcgaagatacgaatttgtgcgttatttatgttaagcgcgtgattattatgtttaaggatatttagttggttcgtcgtattcgcggggagcgggtttaaggtatatttttaagtggtcgatttaaaggttttttttagagttattgtcgtttttattaagagtagttgtatcggttttttatttgatgtgcgtttgttttgcgtagcggttaggggttaggggtattcgtggtgggtgacgttatagaatttaaagtttagtcgtgagttggtcggtagtagagaaagtcgtagaggtatggtttttgtggtttcggtcgagcgtttttacgttggtttaaggttagaggttcggtttttaattttgtgggtaaagttttgtatgggggtaagagattatggggagtttttagatgtggaagattttgagtgtaagggtggggcgagttttttaaaaattataaattcgttttttggtttatttaggaattataagtttaattaaagtttagtattttttttattgtatattataggcggtgtttaagttagaatagtaatttaagcgggcgggagtaaatatttggcgatttttaaaaatgggtgaggtagtattttaaggaagagaaaaaaatttttataaagtatagaataaaaatgtaaaaacgaggtaagagagttaatttgtttagttggcgttaagatttttttcgtatgtaagtttaatggaaagtgaaaattaagaaaaaattttaagtcgtagaaattatcgttttatttagtttaaaattggttagtgtgaaatggattattttgataggataataagatttttgttatagtgattattaaggaagtaagattagaatttattatttatatagattttattttttttgacgatatcgttgtaagttaattaatgaaagcgtagtattttgcgagtttttatttgtatacgggttttataagtagcgtataattagttcgttttgcggtagttcggattatttttttaagtttttttttttttttttcgcgtaaaaatgtcggatttagcgaaattcgtttttgtttttaagaagggttttaaaaaggttgttacgaaagtgtagaagaaggacggtaagaagcgtaagcgtagtcgtaaggagagttatttcgtttacgtgtataaggtgttgaagtaggtttatttcgatatcggtatttcgtttaaggttatgggtattatgaattttttcgttaacgatattttcgagcgtatcgcgggagaggcgtttcgtttggcgtattataataagcgttttattattatatttcgcgagatttagacggtcgtgcgtttgttgttgttcggcgagttggttaagtacgtcgtgttcgagggtattaaggcggttattaagtatattagttcgaagtaagagtgtgtaagggacgtaatagattaattatttaattttaaaggttttttttagagttattttagtaatcgagaaagtagttgtaaatatttgttagagcgtttgatagtttttggttaggtagggagtgttattatggttacggatgtattcgggtttaggattaaggagttttttgtagttttgtaatgagttggtttttagttattttcgtttagttttattgagttgtttgttatttgtgttacgagattcgaaaggtttgattcgttttgggatatttgggagggatggagggaaggaggcggggggtggttttatattttttcggtttttaatttgtatttttaaagtcgtttttttttttgtttttgaaagtaatgaacgagatgagattttttatatagatgagaaattttcggttcgattttttattattttttagtgttttaatttgttttttttattatatatttataggcgtttgttataaattttgtttaatatagttatgtgttttcgttttttagtttttttgtaagttttgatttagttatttttttttaatttttattttagtgattttaaatagggagatatattgttattattttattttttgtggagtatttggtaatatttgtagatgttttgggttgttaggtgtgtgtgtgttgcgggggaggtgttagaagtatttaatgggtagaggttaggagtgttaagtataaggtataggatagttttttggggggataaagagttatttggtttgtaatgtcgatttttggtgattgagagattttagcgtttaaagatatttttaatttttaggatttaattttttttagttaaacgtttttttaattttattagtttatgtttttttttttttggtgaaagttgagtattttataggttgtttataggtttttttttataggaaaatattttttttaggataagaattttgttttggttttaaatttttttaattataagagttatttttgcgtttgttaaatttgtttttaggtgttttttttgaggttttttgatttagttagattggaggtgggatttgacgaggtggttggtttttagtgtttttaggagtgtggatgttttaataggtgttgggtttttatgttaatcgatttgtgggtgtgttatagtttttgtgttatagatgttttgagaaaggaaataatttgaggatgagtggaggggaatttgtggtgtagagaaggttatagttaatatgtggggtgaatttttgaagattttttagtttaaaatttgaataatttaagatttattttgataaaagttagtggatgttttttttgttaaataaaatatatttttggtgtaattggaaaattttagtttataattaatttgatagtttttgaaattaagttatttttgataaattttgggggaattaataattttgtgtttaaaatgaattttattaatttttatgatgttgaaatttaaatttatatttaattaaaagatataaaatgcggtatatatgattttttttttttattagaaaataaagatttttagtttagttatttttttttgattattagataagaggttagggaaagataattgagaatttaaaattttcgttgaaagtaaagaaattatatatagtatattttttggtaggaaaggttatttagtaagtgagacggtcgaggtggtttattttttatatagttgggttataagagaatttatttaatttttttttagtttagggttttgaagttaggagtttttttttttttaaggattagggattatgttttttagggttttttgaagttgttaaagtattgttaattggtttaattatataaatgttattatttattatttattgattaaaagattaatttttaaatttttattttgatattaaaggttatttattatttagttaaaatttattttttttatttgttttttttagttttttagtttagtttaaatgttttattgttatgtaaagtattttaattttgttttttgtgtttttgttatattgttttgagttttagtatttagttttttggattatttgaagttttttattagtttgttagtttttttaaatttttgtttaaa

SEQ ID NO: 1035 - DNA, 6502 bp, Artificial Sequence
  chemically treated genomic DNA (Homo sapiens)
ttaaaataataaaattttattatattttgtgtatatttttagttattataagattattttttttgtgtgtatgtataattaaatcgatttttttttatttaatatattaaagtatatttttttatgttaatatatatttatatttattgttatttttagaagttatatataattttattttatggatgtattgaaatttatttataaaattttttatttgttttttttttaatatattgttattggaaatagtgttgagaaaaacgaattgtatgtatttttaattattttttgaaaatattttagtataatggaattaatgggtaaaggatatatatttttttaagagtgatgtttattattaaattgtttatttaaaaagttaatagtaatttaaattttaagtagtggtgtaagtattattgattttttagattattagtagatttggaaaaagtattttgattaattttaaattatagtttttatttttttaaaaaaaattttttgtaaaaggaagatatattttttattgtaaataataaatgtttatatttatgtatataatgtgaatattttgtaagtatgttgttttttattttgttaatttttttttgatgtaaggggagttttaatttttgttttttaaattaatttgtagaatgtatttataggaaggtttttgttaatataaaaatgtatttgtataaataggtattcgtgtttttttttggtattttttaattttgtatatttaagtttttacgtatattttattaataatttatttttgtaatataaaaatttagttagttttttcgagtttatagatatgttatttataaataatttatttttttatatatatatgaaatgttattaggattaggttttaaaattttatatattttttagtatgtgtgtattttttattttgttttatatatttatttgtttttttattttttagtaaatgaaatttaatattatattttgatatatagaagggtaagtttttattttgttataaaaatttttttaatgttattataagagtaaaaggtagtatacgtaatttagaaattttaaaattttgatgtttttatttggtttatttaaaatgaatagagtttatatttcgagaaaaatgagtttttttatatgtatacgtatgttgattgcggtattatttataattataaagatttggaattaatttaaatgtttataatgatagattggattaagaaaatgtggtatatatatattacggaatattatgtagttataaaaaaggatgagtttatgttttttgtagggatatggatgaagttggaaattattatttttagtaaattattataagattagaaaattaaatattatatgtttttattcgtaagtgggagttgaataatgagaatatatggatatagggaggggaatattatatattagggtttgtcggggggagggggtggggggttaggggagggataatattaggagaaatatttaatgtaggtgacgggttgaggggtgtagtaaattattacggtacgtgtatatttatgtaataaaattgtacgttttgcgtatgtaatttagaatttaaagtataatttaaaaaaaaaaagaagaaaaaaagaaagaaaaatgagtttttttatttaagaatagggaattatttttttattttaaaagatttttttgaggttatttatgaaataatttattatttaggtgtaggtggatataaaagggatattagattttatttaaagaatttttagtttagaagttaatataatatagaaattattttttttatgatgtttgtttttataatatatataatattgtttaaaatgtgtataataaaaataaaaagttatgttttttaattttttttaaagtattaaaatttttagtaaagtaacgggaattatgagaggatcggattagttaaagttttgtttgtcgcgttgtttatattgatgattttgaggttgttatatcggttgttgcgggttgtagagggaataaagtttagcgttttcggggataggggtgagtcgagagtaggaaagggggttttttttcgattcgttttttttttttttttgtcgggttttagtttttattatttgtttttttcgtttttgttatttacgttatttttcggtagagaaaggattcgtcgtatcgtttttgttcggtgtcggtcggtagttttgcggagtttgtcgaattttttgttcgggtcgtggcgtttgggttgggaggaggcgtggtttttatttttattttcggcgttcgcgtttattttttcggggttgttgatcgagttttagggtagttcgttttttttttttttgaagttcgaggttttttttatggtttcgtttatcggtttcggagattcgttggatttttcgtcgttttcggaattttatatgaggaagtaaatcgcgttcgttatagtttttaattaggaaatttcgcgatttttagttttttagaagagaaacggagacgcgttaagtaaagtcgttatacggattgtgtacgcgttttcggtgtttttgcgcgtgatataaatttggtttcgagggagtttcgtgtgtttagttttagagtcgtaggcgagagcgtttgtttgtatgagtgagtatatgggtgtttttgagtttgtgggtgttatagagaggagatcgggagttgtttgtttataggtattttgggatttcgaaagaaaaggttgtgtcgagagagtttttttagttagaggtttgggaatgggggagaagggagtgttcggaatttcgattttagaattgagttttcgaagtgggaaatagtggtttttttatacgtttaagggttaggtaggtgtatttattttgttttgtatggtttaggtgtgagtcggtgggtagaggggtggttttgggtttagttgagaaggttttcgggattgataggggttggggttggggagttttgtttttttgcgtggtttagtgttgggaggggtaagggatgagggtaggggttttatcgttgggttttgattttttaggttatttagattttgtttatgtgggtatttaggggttaggtgtttttagagggaattaagttgggtagggttatcgtttttttttgtagaggaggaagttgaggtttacgaggtaaatagtgggttgggagtgggtttggtagattttaattttagtttatggagattaattattgagggagtattataaacgttttttaacggttggattttttagtttttatgtaatggggtttatattgattttggggttttattgggagagagtaggaggtggtttgaggttgggtatgggtggttacgggggtatggattggttgatttttgtgtattgattatattttttattttttaggtgttatgaagattggatatgggtttattagggttatgggtatgatgttagttaaggaattcgcggtttgtttttgttaagagattagtatttcggtttgagtatttttagttttttatcgtttttaatttggttgtatttagttgttatgtttttatttttttgtgtggttagtattttttaggattttattttgggttatttaaaggtcgaggatattgttggttagtaggaaatttatggtgtatttaggaagatttttaagaggtggtggagtagggggcgttatatttagatagttgtgtgtaattgcgtagttgcgggttgttgcgggtgttggtcggtagtgtattttgggtatattggattgtgttatcgtatgtaggttgtggtcggagggggaattgttggtcgttaaggtttatgtgtttggaaattagtagggttgttgtaggaggagggttgtagaatgttttagtttagatttgatttagggttttagagggtatagggtataaggttgtggatatagatagttttattgcgtaggaagagtataaattagtcggagggtatgtatgtgggttgttgttagattttgtttttttttgaggtagggaaggatgtgtttttattttatggatgagtaaattgaggtagagtgttggagtgattttttttagtaacgatggtagatttagttttagggtttagattttaggatttttttttttaaatattatgatgtattatgggttttttttttatagaaaattagaaatttagaaatggaaagggaataatgaaatttatttatttttttattgtttatatttttttttggtttttttgcgtgtgtatataaaatatattttagaaaattgagtttgtgttgtggatgttatttatattttattttttatatttaatagattatgaaaattttttttgttgttaattatattttttggtagttttatggtttattttatgtacgtgttgttattttttcggagagttttagatttttgtttttagttgtaatatattaggagtgatattttgtttttacgatgttttttttttaagatggagatagatatagcgtttttggattagagagtattgttatttgtaggatttttgattttaggagttgtttttttaattatttggttattttttattttttatttagttttgatgtttattgtaaattgtttgttaatttaacgggtgaatttttagttgttttgatgagtatttttttgattgttggaaggtgataggaaggagttttagtaatattaaaattattgagattggggatttgggggtattattaatgttagttttttttttattaagtgcgcgtatatatatatatatatatatatatatatatatttttattttgttttttaggtgtttaatttgtatggttttggtttgttagtgaggaagaattttttttttttttttatgtgatttgaggttattatatttgtatttggaaattgttaaaattgaggttttgttttttttttttagtgagaatttatgagtatttttaatatttttacgtggatatagatatatgttatttgtagtttttgtgttattttgttttgtttatagatatatttatgggtttagagattagtaaggttatattgttaatttaaatttttgtggaaaaggaaattgatgtaggatttgtttagggttagttttgttgttgagtatttgtgtaattttaattttgttatttgtaaagtgtttttttgatagggtaatggagagattgaggggaatgtagggtcgatggttgtatatcgggaagtgtagttgtgggttttggggatggtatggcgtgggggtttttttaaagggatataggtttttgtagttttgtgggaaggaagttatttaggttaggtgtatagggataggatttattttggtttaattatttgggtagttgaggggttgtggggaaggggttagtttattttgagtaattttttttatagggaagttttacggtatgtattagttggttatattgttaatgagttggatgtggaggacgtatcgtattttttggtggttaatattttggtggttatttggatgaggtttataagtttttgttggtagtttttttttgaggatttagatggtttcgtgttggttttgttggttttgttgcggttggggagaggttgtttttacgatgttaatttaggtgggttgtagagggtaggtagtagcgggatttttttttgaggagggtataggtttttcgtggtttttgttttttattttataatttgggttttggagtaagtaaattttgtttagttttagttttgttatttgttataggtttttatttttttgatttttagtttttttatttgtgttttggttttttaggttgttatggaaattagtcgaagtaggtattttagggtttagtaggttttttgtatacggtaagtgttttgtatttgtttttgttgtggtttcgatgatatcggtgaaggtttttgtttgtgtgtttttgtttttatgtttttttatattatattgttttttaggtgaaaagaggttatgtattttatatgttttatattataagaaaatttagaagaattttttttataaaaggtttaatttaattgtatgaaaagtatttaagaagatagtataaattattgtgatagtataattaaaattggaaagaagtttttatattaagagttatttttatatattataatgttatagatagtgatattgtttttttgtataaaaagtatgaggtaaaagtttatgtagagtttttgattttttcgtttttaagttagaatatttttagttttttcgttcgtgatgtgtcgatttttagaaatttattttgattttgtgtattttgtattttttaagaagaaagtgttaattgaaaattgtatggttattagtgagttttaaataataatagatgagaatttttttgatatgtttattaaaatagaattagagtatgtttttattatttt

SEQ ID NO: 1036 - DNA, 6502 bp, Artificial Sequence
  chemically treated genomic DNA (Homo sapiens)
aagatagtgagaatatattttaattttattttaataggtatattaggagaatttttatttgttattatttgaaatttattgatggttatataatttttaattggtattttttttttgaagagtataaagtgtataggattagaatgagtttttgagagtcggtatattacgagcgaaggagttggagatgttttagtttagaggcgggaaagttaagggttttgtatgagtttttgttttatattttttgtatagagaaatagtattattatttatagtattgtgatatataggaataatttttaatgtgaggatttttttttagttttaattatattgttataataatttatattgtttttttagatgttttttatataattgaattgggttttttgtaaaaagaatttttttgagtttttttgtaatgtagaatatgtaaaatatatggtttttttttatttgaaaagtagtatggtatggaagggtatagggataaaaatatataaataaaaatttttatcgatattatcggaattatagtaaaaataaatataaagtatttatcgtatgtaggaaatttgttgggttttggggtatttgtttcggttaatttttatgataatttaaaagattaggatatagatgaggagattgaaggttaaagaggtgagggtttgtggtaggtggtagaattagggttgaataaggtttgtttgttttaaagtttaggttgtggggtggagagtaagggttacggaaggtttgtgttttttttagagaagagtttcgttgttatttgttttttgtagtttatttgggttggtatcgtagaagtagtttttttttagtcgtagtaaggttagtagggttagtacggggttatttgagtttttaggagagggttattagtagggatttgtgggttttatttaggtggttattagggtgttggttattagaaggtgcgatacgttttttatatttaatttattggtagtgtggttagttggtgtatgtcgtggggtttttttgtggggagagttgtttaggatgggttggttttttttttataattttttaattatttagatgattgggttaaggtaaattttgtttttatgtatttggtttgggtagttttttttttataggattgtagagatttgtgtttttttggagggatttttacgttatgttatttttagaatttatagttgtatttttcggtgtgtagttatcgattttatattttttttaatttttttattgttttgttagggaggtattttatagatgatagaattgaggttatatagatgtttaatagtagggttgattttgggtagattttgtattagtttttttttttataaaaatttggattagtaatatggttttgttggtttttggatttatgggtgtgtttgtaggtagaataaggtaatataggggttataagtggtatgtgtttgtgtttacgtgggaatgttgggaatgtttatgaatttttattgggaaaaggagatagagttttaattttaataatttttagatataaatataatggttttaaattatataaaagaaagaagaaagtttttttttattagtaaattaaagttatataaattaagtatttgggaggtagaataagagtgtgtgtgtgtgtgtgtgtgtgtgtgtgtgtgcgcgtatttggtggggagggggttgatattaatgatgtttttaaatttttagttttagtggttttaatgttgttaaaatttttttttgttattttttagtagttagaggagtatttattagaatagttgagggtttattcgttaggttggtaaataatttgtagtgagtattagagttgggtggaggatgagaggtgattagatggttagggggatagtttttgaagttaaggattttataggtggtagtgttttttgatttaggagcgttatatttgtttttattttaaggagaaaatatcgtggagataggatgttatttttgatgtgttataattaagagtaaaaatttaggatttttcgaaggaataatagtacgtgtataggatgggttatggggttgttaggaaatataattagtaataaaggggatttttatgatttattgagtataaaaggtaggatataaatggtatttatagtataaatttaattttttgagatatattttatatgtatacgtaaaaaaattagaaggaaatgtgagtagtgggagaatgggtaagttttattgttttttttttatttttgagtttttaattttttgtggagagaaagtttatgatatattatggtatttgagagggaggattttaaaatttaagttttggagttaaatttgttatcgttgttgggggaaattattttagtattttgttttagtttgtttatttataaaatagaaatatatttttttttattttaaaggagaatagaatttaatagtagtttatatgtatgtttttcggttggtttatgttttttttgcgtagtagggttgtttatgtttatagttttatgttttatgttttttaaaattttgagttaggtttgagttggagtattttgtagttttttttttgtagtagttttgttggtttttaggtatataggttttggcggttagtagtttttttttcggttatagtttgtatgcggtgatatagtttagtgtgtttagaatgtattgtcggttagtattcgtagtagttcgtagttgcgtaattatatatagttgtttgggtgtggcgttttttgttttattattttttggaagtttttttggatgtattatgaattttttgttggttagtaatgttttcggtttttgggtgatttaagatgaagttttggagggtgttgattatataaggaggtaggggtatggtagttgaatgtagttaggttgaaggcgatgggaggttgggagtgtttaggtcgagatgttggttttttggtagaggtaggtcgcgagttttttggttgatattatgtttatggttttgataggtttatgtttagtttttatgatatttgggggatggagagtgtggttaatgtataggggttagttagtttatgttttcgtggttatttatgtttagttttaagttattttttgtttttttttagtgagattttagggttagtgtagattttattgtatgaaaattgggggatttagtcgttaaggggcgtttgtagtgtttttttagtagttggtttttatgggttgggattggggtttattaggtttatttttagtttattgtttatttcgtgggttttagtttttttttttgtagaaggggacggtgattttgtttagtttagttttttttaagaatatttgatttttgagtgtttatatgggtagggtttgagtggtttgaggggttagagtttagcgataggatttttgtttttattttttattttttttagtattgggttacgtaggaaggtagaattttttaattttaatttttgttaatttcgggagtttttttagttggatttagggttatttttttgtttatcggtttatatttgggttatgtaaggtagggtggatgtatttgtttggtttttgagcgtgtgggggagttattgttttttatttcggaggtttagttttgaggtcgggatttcgggtattttttttttttttatttttaaatttttgattggaagaattttttcggtatagttttttttttcggggttttaaagtgtttgtgagtaggtagttttcgattttttttttgtgatatttatagatttaaaaatatttatatgtttatttatgtagataggcgttttcgtttacggttttgaggttgagtatacggagttttttcggggttaaatttgtgttacgcgtagggatatcggaggcgcgtgtatagttcgtgtaacggttttgtttggcgcgttttcgttttttttttgaggggttgagagtcgcggagttttttggttggaggttgtggcggacgcgatttgtttttttatatagggtttcggaggcggcggaaagtttagcgggttttcgaagtcggtagacggagttatgaagaagatttcgggttttaggagggggaagggcgagttgttttggggttcggttagtagtttcgggaaggtgggcgcgggcgtcgggagtgagagtgaggattacgtttttttttagtttaggcgttacgattcggataaggggttcgataggtttcgtagagttgtcggtcgatatcggatagagacgatgcggcggattttttttttgtcgaagagtggcgtggatgatagagacgagaagaataggtaataggaattggagttcggtagaggagggaggagggcgggtcggggagaggtttttttttttgttttcggtttatttttgttttcgagggcgttgggttttgttttttttgtagttcgtagtagtcggtgtggtaattttaaggttattaatatgagtagcgcgataaataaaattttagttggttcgatttttttataattttcgttattttattgaaagttttagtgttttaaaaaaaattaagaaatatagttttttatttttattgtatatattttaaataatgttatatatgttatggaaataagtattatgagaaaaataatttttatattatattaatttttgggttaaaaattttttggataaaatttaatattttttttatatttatttatatttgagtaataagttattttatgaatgattttagaaggattttttgaagtgagaggatggttttttgtttttgaataggaagatttattttttttttttttttttttttttttttttttaaattatattttaagttttggattatatgcgtaggacgtgtagttttgttatataggtatatacgtgtcgtggtggtttgttgtattttttaattcgttatttatattaggtattttttttaatgttattttttttttggttttttatttttttttttcgataggttttggtgtgtgatgtttttttttttgtgtttatgtgtttttattgtttaatttttatttacgagtgagaatatgtggtgtttggttttttgattttgtgatagtttgttgagaatgatggtttttagttttatttatgtttttgtaaaggatatgaatttatttttttttatggttgtatagtatttcgtggtgtatatgtgttatatttttttaatttagtttattattatggatatttgggttggttttaagtttttgtaattgtgaataatgtcgtagttaatatacgtgtgtatgtgggaagatttatttttttcgagatgtgaattttatttattttagataaattaaataaaagtattaaggttttaagatttttaggttacgtatgttattttttatttttatgatgatattaagaaaatttttataatagagtaaagatttgtttttttatatattaaagtgtgatattaggttttatttattaaaagatgagaagatagataaatgtgtggaatagaataaaaaatgtatatatattgaaaaatgtgtaagattttagaatttgattttgatgatattttatatgtgtatggaaagatgagttatttgtaaatgatatgtttgtgaattcgagaaaattagttagatttttatgttataaaaataagttattgatagaatatgcgtaaaaatttaaatatataaaattagaaaatgttagaagaaaatacgaatgtttatttatatagatatatttttatgttgataaagatttttttatgaatgtattttgtaggttgatttagaaaataaaaattaaaattttttttatattagaaaaaagttaataaaataaaagataatatatttgtaaaatatttatattatatatataaatatagatatttattatttgtaatgaaaaatgtgttttttttttatagagaattttttttaaagaaataagaattataatttaaaattggttaaagtattttttttaaatttattagtgatttggaaaattagtagtatttatattattgtttaaagtttaagttgttgttaattttttaaataaataatttggtggtgaatattatttttaaaaaggtatgtattttttatttattgattttattatattaaaatatttttagaaaataattagagatgtatataattcgttttttttagtattgtttttaatagtaatgtattaaggagagggtaaataaaggattttataaataaattttagtgtatttataggatgaaattatatgtaatttttgaaggtggtaatagatatggatgtatgttgatatgggaagatgtattttggtatattaagtgagaaaaaatcgatttgattatatatatatatagagggaatggttttgtggtagttgaaagtatatataaaatgtgataaaattttgttattttgg

SEQ ID NO: 1037 - DNA, 6173 bp, Artificial Sequence
  chemically treated genomic DNA (Homo sapiens)
agtggagatgggttttattatgttggttaggttggtttcgaatatttgattttaagtgatttatttattttagttttttaaagtgttgggattaaaggtgtgagttatcgtatttggtttttcgattttttttttttgtttttaaatagagaagggggttttattatgttgtttaggttagttttgagttttttgttataagtgatttttttgtttggattttttatatgttagtttagatattttttataattttgtttaagtttagttatacggtttttttagttttaaggaggaatgaaatattatttggaaataatttgtttgatgtttatattattgaatataatattataattttaatttagttttttaaattttttttggaatcgttttgattgattagggttgtgttttattaaattttgtatatttgttattatttgatagttatttttattatttttagttgtgtgtaaaattgttttaaggaagtttagggtttagagatttatgtttgtgtagatatgtagaagaattttttttaatattttaaaattattaattagtggatgtttttgggatttaatttttatttaattaagggtgaaagtttagtttgtatattttttgagttttttatgttgttgaatttaaatcgaagttttttttgtttttattttttttttagtattaatataaatatagtattttattattttttaagtggtattttatttatttttttattttgagggtgattgtgtggtaggtttagttgtagggggtttatttagtaagttgttttaaaattttttttagttttaggtgtgaattggttatgttttttgttagtaagggttgatggatttaatttttttatttatttaattatttatttagtaagttattattgaatgttaaggttgtattatgatttttaagggttttaagtttttttgtttttgtggtttttttttgtttgaaaatatatttaaaattatattttatgattgtattgttattaatgatgattataatttagattggatttattataatatagtaaatatattatttttttttgaaaaaatttttttgagatggggttttattgtgttatttagtttggagtgtagtggttcgattattgtttattgtagttttaatttttttaggattaggtgatttttttattttagttttttaagtagttgggattataggtatacgttattaagttcgattaatttttgtatttttagtatagttagggttttgttacgttggttagattggtttcgaatttttggttttaagtgatttatttattttagtttttataaagtgttggaattataggtatgagttatcgcgtttagttatttgttttgattttattttatttattttttttatatatgtatttttgagacggagtttttttttgtcgtttaggttggagtgtagtggtatgatttcggtttattgtaatttttgttttttaggtttaagcgatttttttgttttagttttttaagtagttgggattataggtgtatgttattaggttaggttaatttttgtatttttagtagagacggggttttgttatattggttaggttggtttcgaatttttgattttaggtgattcgtttgtttcggttttttaaagttaggattatagacgtgagttatcgttttcggtttttttgtttttttttttttttttttttttttttttttgagacggagtttcgttttgtcgtttaggttggagtatttttagtatgcgaggtggttatgaacgataaggagaaaaaataaggtgaaggggaatggggagtgttggtaatttagatagaatgtgtacgaaaggttttaatgggaaattttaatttgaataaaaacgtataaaacgcgaggaaagtttaggaatatattagtcgtatattttgtcgtagagaagttaaggatgaggaataggtattaagaataaattttagcgtaaggttttttttaagtgcggtttttagggttacgtatttttattgtttataggcgaggtcgcgggtttgtaaataagcgattgtcgttgtaatttttattttgttttttggtattaaatttaggttgatttatttattgttattttttttttattttcggtttttttttttttttttttttttttttcgagatagagtttcgttttgtagtttaggttggagaatagtggcgcgatttcggtttattgtaattttcgttttttgggtttaagagatttttttgttttagtttttcgagtagttgggattataggcgcgcgttatttcgttcggttaagtttttgtatttttagtagagacgggtggggggaggggggagggggttattatgttggttaggttattttcgaaatcgtgatttcgtgattcgttcgtttcggttttttaaagtgttaggattataggcgtgagttattattttcggttttgggtgttggttttttttattttcgagtgaatagtagagggggttgttgggtgagggttagaagagttggggaggtacgagggcgtttagcgttgtttttatttaagatggcggttagagtttcgcgtttggtcgcgtggggcggtgcgtgagtgtttagtttataggtttcgggatcgcgttcgggggcgggtttatagtgggaaggggacgcgcgttttgcggttcggtttttagttatcgttttcgtagcggcggttaatattatcgttattgttattttttttagattgtggacgggaggatggagtcgatggtcgtcgttatcgacggcggggagaggtcgggggttttagcgggtttaggtttgtcggttttttagcgtcgggcggagttgcgtcggagaaagttgtttatgaattcggaatagcgtattaatcggattatgggtttttataggttcgggagcggcgcgggtaagagtttcgatttttttttagtttttcgtttattattttgaatttttagggttattttttttttttttatttttatttttttgatttttttgattaagttttgttttttgattttttttttgtttcgttttttcggtgatattttaagtttttatttttgaattttaggatgtttttagtcgttttttttaattttttcggggtttcgtcgtgagattttttttattttgtttgtagagtttttattttttttttttagttacgttgaatagttttttttttttttagttatttttcgttttttttgaagggcgtacgttgtatttttagattgttatgtttattgttttttttaggaagatggtttttttttttaaggttttaagtgtttttttttatagtgttttttttagcgtttatttttttttgttttttgttgtgtaatttttgttcgtttatattagtttgtttttattgaattgttcgttagtttattttacgtgtattagggatttttgtgtttatattttagtgtttgtgtttagtgtcgttaatattgttatttacgggtcggttagaaaaggtgggaaaagtgagagtgagtattttttagagatttagtaagtgcgaagtgtatatttgagagttttttttttttatgaggggatattgttgtgattgatgtttggagttgtatttttaaggagagcgtttttttttttttttaaatatatgtttaatgattttttttaaaaaaaatttattttacgtgagtataattgagtaattagcgcgttttagtgttatttaagtttttagtgttttttttagtaattggtttttagttattggtcgtaagttttttatatttttgtgatttttgttttgtaaggttttaggtgtatagttttgaatttttaggtagtttaaatgagaggtaagaaaattattttaaatttttttagaataatagaagaaatatttttttatcgggttatttatttttaaagtattatttatgattttatttgaggtattttttatattttgtttttttgttttgaaaattttatgtttttaaaggttgttttattttttgagatagggtttttttttgtaggttaggttggagtgtagtggtatgattatagtttattgtagttttaaatttttgggtttaagtaattttgttattttagttttcggagtagttaggattataggtgtatattattatgtttggttaatttaaaaaaaaattgtgtgtgtggagatgggggggttttattatgttttttaagttggtttggaatttttgggtttaagtgatttattagttttggtttttaaaagtgttgggtttataggattataggtgtgagttattgtgtttggttttttttttaaaataaaaataaaaataaaattttagagtagtgttttaaaattgttgaagtgtttattaatggttgtttgattatataaatagtagttttgggatatgttatattttatgtttatagggtattggatttagaaatttaattttaaaatatagattttaaaaggttttattgattttatatttttaattaaataagttaaggtaggtaatgtaattatatatttgggatatattatttataaaaagttggtttttttagtttgttttatttttgaatattttttttagtttgtttattaattttattttttatttataaagtttgggttattttttttgtagaatatttattttgggtgatatattttgagggtgtagaggaagaatttagttttttttttttttttgttttgagatggagttttattttgtcgttaggtagatgtagatggagtgtagtggcgtagtgtttgtaatttttttttttcgggttttaagtgatttttttgttttagttagagtagttgggattataggtagttgggattatagatatacgttattatatttagttaatttttgtatttttagtagagacggggttttattatgttggttaggatggttttaattttttgattttatgattcgttcgttttagttttttaaagtgttgggattataggcgtgagttacggtatttggtcgaaattagtttttttttaatgtagaatcggtatttatttattttgatgtagaggttgttgagttttagttgtaatagtatattttaaaatataaatatgtaaggtgtttgttagtatggaataaatatataaggtttttatatttttttttttagaagaagaaagttaaataaaattaaagtagtaggatagtgataaattgaatttttttagcgtttttttcgttttaaagcgagtagtgttgggtgatttagttagtataggaataattgattagtagggtggtgtggtcgaggtaaaggggatttaattgggagataaattggattcgtttattaaattatttgagtgtagtagtgatgttaattttgagtttcggtagcggaatagaggggatttgatagcggattcggtttagaggggttttcgttatggtttagagtagtatttttttagattcgaagaagtaatgaagttaaggaaatagttgattagtgaaaaatttagttaagaggatggaaatataatagaagaatttgatttttttcgaatatttagattggtgggatgtgttttttttgtttttggagttagagtttttgtttgtaaatatttggtaagaaaagatttgtaaattattaattaatttaatggaaaatgtaaaatgttaataattatgagtgtttttgattatagaagttattgttagtattaatatttattagatttatgtggttgtttgaagatatattattaattttgttatttattttatagaatgaagtgttttggttaaatatagagtttaataattattgttggttttttatattagttggttttgtattttatgtggatttaattaattgtggattgaaaatatttggatttagtcgggcgtggtggtgtacgtttgtaattttagttatttgggaggttgaggtaggagaatcgtttgaattcgggaggtggaggttgtagtgagttaggataacggtattgtattttagtttgggtgatagagtgagatttcgttttaaaaatatatgtatgtgtatatatttgggggaaaaataataatata

SEQ ID NO: 1038 - DNA, 6173 bp, Artificial Sequence
  chemically treated genomic DNA (Homo sapiens)
tgtattgttattttttttttaaatatatatatatatatatatttttgagacggggttttattttgttatttaggttggagtgtagtgtcgttattttggtttattgtaatttttatttttcgggtttaagcgatttttttgttttagttttttaagtaattgggattataggcgtgtattattacgttcggttaaatttaaatatttttaatttataattggttgaatttatatagggtgtagaattaattgatatggagggttaatagtaattattaggttttgtatttaattagaatattttattttatgagatgaatagtaaagttaataatatatttttaaatagttatatggatttggtagatattaatattggtaatgatttttatgattaaaagtatttataattattaatattttgtattttttattaagttagttaataatttatagatttttttttattaagtatttgtaaataaaagttttgattttaagagtaagaagagtatattttattaatttaaatattcgaaaagagttaaatttttttgttgtatttttatttttttgattgggttttttattaattagttgtttttttagttttattgttttttcgaatttggaaaggtattgttttaggttatggcgggaatttttttggatcgagttcgttgttaggttttttttgtttcgttgtcggagtttaaggttgatattattattgtatttaggtggtttaatgaacgagtttaatttgttttttagttgggttttttttatttcggttatattattttgttggttagttgtttttgtattgattgaattatttagtattattcgttttgaaacggaaggaacgttgagggagtttagtttattattgttttgttgttttgattttgtttgattttttttttttgagaaaagaaatgtaaaagttttatgtatttattttatattggtaaatattttatatgtttatgttttaaaatatgttgttgtagttagaatttagtagtttttgtattaaaataaataaatatcgattttgtattaaagaaaagttggtttcggttaggtgtcgtggtttacgtttgtaattttaatattttgggaggttgaggcgggcggattatgaggttaagagattgagattattttagttaatatggtgaaatttcgtttttattaaaaatataaaaattagttgggtgtggtggcgtgtgtttgtagttttagttgtttatagttttagttattttggttgaggtaggagaattatttgaaattcggggggaggaggttgtagatattgcgttattatattttatttgtatttgtttggcgatagagtgagattttattttaaaataaaaaaaagaaaaaagttggattttttttttatatttttaaaatgtattatttaaaatgaatattttgtagaggaaataatttaaattttgtgggtaggagataagattagtagataaattgggaaagatatttagagatggagtaagttgaaaagattaattttttatggataatatattttagatgtatgattgtattgtttgttttagtttatttggttaaaaatataaaattagtaaagttttttaaaatttatattttaaaattagatttttgaatttagtgttttatgagtatagggtgtggtatattttaaagttattgtttatgtagttaggtagttattagtaggtattttagtagttttaagatattattttggggttttgtttttgtttttgttttaaaaaaaaggttaggtataatggtttatatttgtaattttgtaagtttagtatttttggaagttaaggttggtggattatttgagtttagaagttttagattagtttaggaaatatagtgagatttttttatttttatatatataatttttttttaaattagttaggtatggtggtgtatatttgtggttttagttatttcggaggttgaggtagtaggattgtttaagtttaggagtttgaggttgtagtaagttatgattatgttattgtattttagtttggtttatagagggagattttgttttaaaaaataaaataatttttaaagatataaaatttttaaagtaaaagaataaaatatagaaagtattttaggtaagattataaataatgttttaagaataaatagttcgatagaaaaatgttttttttattgttttagaagaatttgaaatggtttttttattttttatttgaattgtttaaaagtttagagttatatatttaaagttttatagaataaaagttataaagatataaggagtttgcgattagtgattaaaggttaattattaaaggaaatattggaaatttagataatattagggcgcgttaattgtttaattatatttacgtgaaataaattttttttaaagaaaattattggatatgtgtttgggggaggaaggaggcgttttttttagaaatgtagttttagatattaattataataatatttttttatgaggagaggaaatttttaggtgtgtatttcgtatttgttgggtttttgaagaatgtttatttttattttttttattttttttagtcggttcgtaggtgatagtgttgacggtattgaatataaatattaggatatgagtataagagtttttgatatacgtaggatgaattagcgggtagtttagtaaagataggttgatgtgggcggataggagttatatagtaaaaggtaaaagaaggtagacgttagagaaggtattgtaaggaaaagtatttggaattttaagaaggaaagttatttttttaaggggagtagtagatatgatagtttggggatataacgtgcgttttttaagaaaggcgaggagtggttaaggaaaaaaggggttgtttaacgtaattgggaagagggagtgagagttttgtaggtagggtggggaaaattttacggcgaggtttcgggaaaattgaggggagcgattaggaatattttggggtttagggatgagaatttgggatattatcgaaggggcgggatagagaggaaattaaagagtaaggtttggttaaaaaggttagaggagtggaggtgggagagggaagaatgattttgaagatttaaggtgatgggcgggagattgaggggaaatcgaggtttttattcgcgtcgttttcgggtttgtgaaagtttatgattcggttgatgcgttgtttcgagtttatgagtagtttttttcgacgtagtttcgttcgacgttgggaagtcgatagatttgagttcgttgggattttcggttttttttcgtcgtcggtagcgacggttatcgattttattttttcgtttatagtttgggaggggtggtagtggcggtgatgttggtcgtcgttgcgagggcgatgattagaggtcgggtcgtagggcgcgcgttttttttttattatagattcgttttcgagcgcggtttcggagtttgtgagttaagtatttacgtatcgttttacgcgattaagcgcgaggttttggtcgttattttgagtgagggtagcgttggacgttttcgtgtttttttaatttttttggtttttatttaatagttttttttgttgtttattcggaggtgaagaaaattagtatttagggtcgggagtggtggtttacgtttgtaattttagtattttggaaggtcgaggcgggcggattacgaggttacgatttcgagagtagtttggttaatatggtgatttttttttttttttttttattcgtttttattaaaaatataaaaatttagtcgggcggggtggcgcgcgtttgtaattttagttattcgggaggttgaggtaggagaattttttggatttaggaggcggaggttgtagtgagtcgagatcgcgttattgttttttagtttgggttatagagcgagattttgtttcgagaaaaaaaaaaagaaagaaaagaaaatcgggagtgggaaagggatggtagtaagtaggttagtttagatttggtgttaggaagtaaaatggaggttgtagcggtagtcgtttgtttatagattcgcggtttcgtttgtaggtaatgggaatacgtaattttgggagtcgtatttaaagggagttttacgttgggatttgtttttggtgtttgttttttatttttaatttttttacggtaaagtatacggttgatgtgtttttaggtttttttcgcgttttgtgcgtttttatttaaattagaattttttattgaaatttttcgtgtatattttatttaaattgttaatattttttatttttttttattttgttttttttttttgtcgtttatgattatttcgtatgttaaagatgttttagtttgggcgatagaacgagatttcgttttaaaaaaaaaaaaggaaaagaaaagaaaaaaataaaaaggtcgggagcggtggtttacgtttgtaattttaattttgggaggtcgaggtaggcggattatttgaggttaggagttcgagattagtttggttaatatggtaaaatttcgtttttattaaaaatataaaaattagtttgatttggtggtatgtatttgtaattttagttatttgggaggttgaggtaggagaatcgtttgaatttgggaggtagaaattgtagtgagtcgagattatgttattgtattttagtttgggcgatagagggagatttcgttttaaaaatatatatataaaagaaataaataaaataaaattagaataaatgattgggcgcggtggtttatgtttgtaattttagtattttgtgagggttgagatgggtggattatttgaggttaggaattcgagattagtttggttaacgtggtaaaattttgattgtattaaaaatataaaaattagtcgggtttggtggcgtgtgtttgtggttttagttatttgggaggttaaggtgggaggattatttgattttggggaggttgaagttgtagtgagtaatgatcgggttattgtattttagattgggtgatatagtgagattttattttaaaaaagtttttttagaaaaaaataatatatttgttatattgtaatggatttagtttggattatagttattattaatagtaatatagttataaaatataattttaagtatgtttttaggtaggaaggagttataaaggtaaaagagtttagggtttttgaaagttataatgtagttttggtatttagtaatgatttattaagtgaatgattagatgaatgaaggaattgaatttattaatttttgttaatagggagtatggttagtttatatttgaggttgaggagggttttgaagtagtttattgggtgggttttttgtaattaagtttgttatataattatttttaaaataaggaagtgggtgaaatattatttagaagataataaaatattatatttatattaatattgaaaaagaagtgaaaataaaagaaatttcggtttggatttaataatataaggagtttaaagaatatatagattgaatttttatttttgattggatgaaagttaaattttagggatatttattagttaataattttaaagtattagaggaagtttttttgtatatttgtatagatatagatttttgagttttagatttttttaaaataattttatatataattgaaaataatggaaataattgttaaatagtaataaatgtgtagaatttgatgaggtatagttttgattaattaagacggttttagaaagggtttgaggagttaaattagaattatagtgttatatttaatgatataagtattaagtaaattatttttaagtaatattttatttttttttgaaattgaggaagtcgtataattgaatttgaatagaattataaaaaatgtttgggttggtatgtgggaggtttaggtaggaggattatttgtggtaaggagtttaagattgatttgggtaatatagtgagatttttttttttatttaaaaataaagaaaagagatcgggaggttaggtgcggtggtttatatttttaattttagtattttgggaggttgaggtgggtggattatttgaggttaggtgttcgaaattaatttggttaatatgatgaaatttatttttatt

SEQ ID NO: 1039 - DNA, 6514 bp, Artificial Sequence
  chemically treated genomic DNA (Homo sapiens)
tgttattattttaaaagatgtgaattttattatttagagtttttagagagagttttttagatagtattttaaggagttaattttttttaaattatatatgtattttttagttgttgtttttttaaaagaatattttatatttaagaatgttgttttatttttttgagatagagtttcgttttattgttaaggttggagtgtagtggtgttttttgtaattttcgtttttcgggtttaagtggtttttttgttttagtttttcgagtagttgggattataggtatgtattattatgttcggttaatttttgtatttttagtagagattgggttttattatgttggttagggtggtttcgagttttcggttttaagtgatttgtttgtttcggttttttaaagtgttgggattataggcgtgagttattatgtttagtttttgttttggttttaaaagtatttataatatttaaatgtttatgttggttatttatttttatttagtttataggtagaaaaaaaaaagtttatttagattaaattttgtagtaatttttttttttattgttattattgttaaagaattgtgtgttattattaggttaagttggtgtagtatttaaaatatttgttaatttgtttttttttagattggaggggtttaggtagtttttttaggatttattatattttgtattttaattttattaataatatttttattttttttgtattagcgatttatttaataaattaaattatatattattattaggttagtttttaaatagtttagtagtaataagaataataagatgttggtcgtattttaattttattggtagaaattgagggttttattggtgaagaaatttgtttaggattatagtgttttagttttttagggttattataataaaatattatagatagggtggcgtaaataatagaaatttgtttttttatggttttggaaattagaagtttaggagtaggtaggtttggttttttttgaggtttgttttttttatttgtagagggtcgtttttttattgtgtttttataaggttttttttttgtgtttattatttttggagtttttttttgtggtttaattttttttttttataaagatattagttaaattggatttagggtttattttaatggtttcgttttaatttaattatttttaaacgttgtgtttttagatagttatattttgaggtatttaggtttttatagatgaattttggaggatataatttagattataatataaggtaatatatggtttagatgagatttgaatgaatgattagtttaatttttaagtagatttttttagtagattgtaaggtgtattggagagttttagattagaggtttaagaggttatttaggtaatatttatagaattgttaagtgttaggattgggggatgtagtagttacgaaaatcgtttttcgttttagtaagtttatagtttattatggggaagagataaatattgaataggtagttatattatttttagtaaaataataattgggaatagtttttggggattattttatatatggaggaaatgtaaaaaatattttgttaggattatttttgtagtaaattagatgtgattaggttaattaaatatggttattgtgaattattttattgagtatagaagtggttttgttaaaaatggatttttttacggagtacggtggtttatgtttgtaattttagtattttgggagattgaggtaggaggattgtttgagattagtttgggtaataaagtaagattttgttttaaaaaaaaaaaaattagggcgtggtggtgggggtttgtaattttaattattcgggaggttgaggtaagagtattatttgagtttgagaggtggaagttgtagtaagttgagattgtattattgtattttagtttgggcgatagagtgagattttgttaaaaaaataaaaaataaaaaaataaaaaaaattaatttttcgtatatttttgttataaagaagtttttaaaaaattgtttgtttttttaagttagtttttttattgagtttaaatttcgttttaatttgaataaatatggatgttaatattattttttatagttattagtgttaagtgcgttgtatgtaatattttgaatatttattgaagtttgtaaggttggttttatgttttgattattgatggagatataaattttgaataattgtgattttagggatgttaaatattatagtgaggtacgatgcggggatttgaattttggtttgagggttttagagttgtggttttttttggggttattttgttaattgatttttagttttttttgatttataagtcgcggtattataatttttagatgttgaagaaaattaaattatatgttaaggattaaggtttgtgaatttttaaaatttgggataggttttagttaatttagaaagtttattttgttaacgttaaggacgcgtagttgtgatatagttttaggaagtttagatgatatgtgtttaaggtggttggggtatagattggttttatatattttagggagataggagatattaattaatatatgtaagtatattggttttttttagaaaggtggggataattcggaagtaggaagggtttttaggttataggtagatgagagataaaaggttgtatacgagtttttgataagtttttttaaaggagataattagaatatgtatttattttagtgagtagaaggatgattgattagaatgggaggtaggttttgttttgagtagtttttagtttgattttttttttttgtttagtaattttgggattttaatatttttataggttttaaattttattattttttagttattacgtgttagtatataaataaatagtataaaattaagaaggtatttattttttggttgtttttttacgtgtaaaataatattttgtgttaagtatttttatatacggcggcgtaaaggtagaaatcgatattaaaaaagcgtgtagaaaatagtttttagtttgggtaatatagggagattttatttttataaaaataattcgttaagtatagtggtgcgtatttgcggttttagttatttgagaggttgagatgggaaagttgtttgagttcgggtagtaggagttttaggttgtagtgagttaagaatgcgttattggattttagtatgggcgatagcgtgagattttgttttaaataaaaataaaagttcgttattttattaagaaggcgtttttgtatattgttttaatgtttaacgtttttaggatgttagcgtgacggaagtaagtaattattaaggtattattattggcgttaaattttttattttcggagtgttgtaagcgtagaaaatatacgttatgtgcggaggcggagttttcgttttgcgcgtcgtattagacggaaatcgagcgggtttattttttatgggtttgcggatttattagcgaaggcgggaggtgtcgtagggatattttttggttgttttcgtcgtttgcgtggtttttgtatttcggttttttattagcggcgtagacgtttgggtttaagcgttgggcgaggcgaggttttgttttttttcgttaacggttattttttggatttgtttttttttcgggaggcggtgatagttgttgagacgtgttgtagttagagttttttcgttttaatgcgtttttattagtgtcgttttttattggaaaatcgtggtttttgtattatttgttatttttgttgtgtaggagtagggagggttttttttcggggttttaggcggcggtgtagttcgtcgtagaagaattagagtagaagttgtcggggttcgtttttaggacgtagtcgttttatgggggtttaggggttttggaagttgttggagtgtttcgggcggtaggttagtttcgaagcgttggaagggaagattttggttgttggtatttttaacgtcgcgttgggatttggggtgtagggattcggggttggatttttcgcggggttttgttttgggtatagtggtatttgtaggatgatggttttgggtcggggtcggggtcgttatagaatttttgttattaggttttttaagtatagtcgtttttcggtattttcggggttttggttttagtttttttttcgtatattacgatgtttaagtttttttaatttttttatataatggcgtggtatttgtatataaattatttattttcgtaattttttaaatcgtttttagtttatttgtaatgtcgaatgtaatgtaagtgatttgtaaatagttgttatattgtattttaaaattttttgtagtttttattggtatgttttatttatttatttttttttatcgtaaatatttttgattcgtggtaggttgattgcggaatcgggtgatgaggcgggtcgttttgtttgttttttttagttttgtagttttagcggtttgtgtattttggtttgttattttgtggtagtgttttatgtttttttttgttttagtttttttatttgtaaagtagaggtggtgatagtatttatatataggattggaatgaggaataaagaaattgtttatatgagagaagtttagtgcgattaatatagtaaattttaaagttattattttgttcgggaggttagtaaggagagtagagtagatttcgacgattagttttgtttgagttttgttttatttatgttttttagaggaaggatagtgtggataggtgttttatttattttttaaattgattttttaaggattattgtttttgtatatgtttggttggttttgtttgttattggaattaaattttttttttattagtaaaacgtgatattgtttttgaaatttttatttttttttttgttatgtagttattttttttttttttttgagtatttattttggtttagaatttggtgatattttatattaattttttaaatggggatttatgagtttaggggttcgtgggtttgtggaaagagttttgtaaatgattgcggggggattggggacgggaaatggagtgtaagagtgtgtgggcgtttagtaaaggaatttttgattgtggagttttaattttttagtaggtataaaatttataaataaaacgatattgataagttttaaaatataatgagattattattttttgtaagtgaataatttttaaataaatttgtaattgatttttggtttaaaagtttttatatagggtattttgaattggggaaagttaaaggatttttgttttgttttgttttgttttttgttttttagagtatatgcgttgttgttgtttttaagttgttgtttagtattattgtagtttaaagatttttttagaaataaagggtaaaggttagtttttagtgataagaatttttaaaattttagtaaagatttagattattttatgtagtagtttttgtgaagaattattaaagaggattgtggttaggtttagtggtttacgtttgttattttagtattttgggaggttaaggtaggaggattatttgagtttaggagtttaagattagtttgggtaatatagtgaatttttgtttatatatagttaaaaaattagttggacgtggtggtttgtatttttggttttagttatacggaaggttgaggtaggaagattgtttgggtttaggcggttaaggttgtaatgagtcgtgtttatgtttgtttttgaataaataaataaaaaggattgtgaaagatattttagttatgataattttatatatttataataaattcgtttatgttaaaggagtatatttgattatttgttttataatcggttttgttttattttatttttacgggaatttagatatttgaaattatttagattttattgtattgtttgttaatgataaatttattcgttattatattagttttataatttatttttgtatttttatattaaattgtttggtttttaaattatttatatagtttagtgttttatttatatagtttaaatgtttgtgttaaataatgtagaagtaagttaaatttttgttttttatagattttaatgtttgtaatatgcgtttaagtgtattagtaagatattattatttttttaggttatgtatattaatggagatttttaagttatttaattaaagaattaaagaaatttattttttgtattgaaatgttattggtttttgggttttatatcgaaagtgatttttggttttgttgtagattttaatttttttgttcgtagaaatttaattttgcgtatataaatttattgaaattagataagttaaattatataaatatttttagattgttttattttttatattttttgtttaataatttatgtgaatatttttaggtcgtttaattttatatattttatttttaagaatttaagttaaaatttttaattttagttgagaattggtattatttgt

SEQ ID NO: 1040 - DNA, 6514 bp, Artificial Sequence
  chemically treated genomic DNA (Homo sapiens)
ataggtaatgttaatttttagttagggttgagaattttggtttgaatttttagagatgaaatatgtaaaattagacgatttgaaaatatttatataaattgttagataagaaatatgaaaaatgagataatttgaaaatatttgtataatttgatttgtttaattttagtaagtttatatacgtaaaattaaatttttgcggatagaaaagttaaaatttgtagtaaagttaaaaattattttcggtataagatttaaagattaataatattttaatataaaaaataagtttttttagttttttagttaggtgatttaaaaatttttattagtatatatagtttaaagagatggtaatattttgttaatatatttaaacgtatattataaatattaaaatttataagagataaaagtttaatttatttttgtattatttgatatagatatttagattgtataaataagatattaagttatatagatggtttaaagattaaataatttagtatagagatataagagtaaattatgaaattagtataataacgggtaagtttgttattaataaataatataataaaatttaaataattttaggtgtttgaattttcgtgaaaatgaaataaagtaaaatcgattgtagaataagtaattagatatatttttttgatataaacgagtttattataaatatatgaggttgttatgattagaatgttttttatagttttttttatttatttatttagagatagatatgaatacggtttattgtagttttgatcgtttgggtttaagtaatttttttgttttagtttttcgtgtagttgggattaaaggtgtaggttattacgtttagttaattttttgattgtgtgtagataggggtttattatgttgtttaggttggttttgaatttttgggtttaaatgatttttttgttttgattttttaaagtgttgggatgataggcgtaagttattgagtttggttatagttttttttagtaattttttataagggttgttatataaaatgatttaaatttttgttgaagttttaagggtttttgttattgaaaattaatttttattttttatttttgagaaaatttttagattgtaatgatattaagtaatagtttgagggtagtaatagcgtatgtgttttaaaaaataaaaaataaaataaaataaaataaaaattttttggttttttttaatttaaagtattttgtataaaaatttttaagttaaaaattaattatagatttatttaaagattatttatttgtaaaaaatgataattttattatgttttaaaatttattaatgtcgttttatttataagttttgtatttattgaagaattagggttttatagttagggatttttttgttgaacgtttatatatttttgtattttatttttcgtttttaattttttcgtaattatttataggattttttttataagtttacgagtttttagatttatagatttttatttaggaaattggtgtaaggtattattagattttgagttagaatagatatttaaaaaaaaaaaaaaaatgattatataataaagaaaaagataaaaattttaaaagtagtattacgttttgttaatgaaaaaagaatttaattttaatgataaataaaattagttaaatatgtatagaaataatagtttttaaaaagttaatttaaaaaatgggtaaaatatttgtttatattattttttttttaagaaatataaatggggtaagatttaagtaaaattaatcgtcgaagtttattttgttttttttattgatttttcggataggataataattttaagatttattgtattaatcgtattaaattttttttatgtaggtaatttttttattttttattttaattttgtgtgtagatattattattatttttattttgtagatgagagaattaaggtagagaggaatataaagtattgttataaagtgataaattaggatgtataggtcgttaagattgtaaagttggggaaagtagatagggcggttcgttttattattcgatttcgtaattaatttattacggattaaaaatatttgcgatggaaaaaaataaataaataaaatatattaataaaaattataaaaaattttaaaatatagtataataattatttatagattatttatattgtattcggtattataagtaagttagaaacgatttaaaagattacggaagtgggtagtttatatgtaaatattacgttattatataagggagttgaaggaatttgaatatcgtggtatacggaggaggggttggaattaaagtttcggggatatcgagggacgattgtatttagaaaatttagtgatagagattttatagcgatttcgatttcgatttaagattattattttgtagatgttattgtgtttaaggtagagtttcgcgaggaatttagtttcgaatttttgtattttaagttttaacgcggcgttaaggatattaatagttaggatttttttttttagcgtttcggggttgatttgtcgttcggagtattttagtagtttttagagtttttggatttttatgaggcggttgcgttttaagagcggatttcgataatttttattttaatttttttacgacggattgtatcgtcgtttaggatttcgggaggaagttttttttgtttttatataataaagatggtaaataatatagaagttacggttttttagtgggggacggtattaatgggagcgtattaaagcggagagattttggttgtaatacgttttagtagttgttatcgtttttcggaagaaagataggtttagagaatggtcgttggcggggaggggtagggtttcgtttcgtttagcgtttaggtttaaacgtttgcgtcgttaatggaagatcggggtgtaagggttacgtaggcgacggaaatagttagaagatgtttttgcgatatttttcgttttcgttggtgggttcgtaaatttatgaaaaatgggttcgttcggttttcgtttaatacgacgcgtagggcggaagtttcgttttcgtatatgacgtatattttttgcgtttgtagtatttcggaagtgagaagtttagcgttagtggtgatgttttggtggttatttgttttcgttacgttggtattttgaaggcgttaagtattaaaataatgtgtaaaagcgtttttttggtggagtaacgggtttttgtttttgtttgagatagggttttacgttgtcgtttatattggagtttagtggcgtatttttagtttattgtagtttggaatttttgttgttcgagtttaagtaatttttttattttagttttttaagtagttgggatcgtaggtgcgtattattatgtttggcgaattatttttgtagaaatgaggtttttttgtgttgtttaggttgggaattattttttatacgtttttttagtatcggtttttatttttgcgtcgtcgtgtgtgaagatatttaatataaagtgttgttttatacgtgaagagataattaaaaggtggatgtttttttggttttgtattatttatttatatgttagtacgtagtaattaaagaataataaaatttaaagtttgtgaaaatgttagggttttaaaattattaagtaaaagggaaaagttaagttgggaattgtttagggtaaaatttgttttttattttagttagttatttttttgtttattgagatagatgtatattttgattgttttttttggaaaggtttattagaaattcgtatgtagttttttgttttttatttatttgtgatttagaagttttttttgttttcgagttgtttttatttttttggaaggaattagtgtatttatatatgttgattgatgttttttgtttttttaaaatgtataaaattaatttgtgttttaattattttgggtatatgttatttggattttttggggttgtgttatagttgcgcgtttttaacgttggtaaaataaattttttaaattaattgagatttgttttaaattttgggggtttataagttttaatttttgatatatagtttagttttttttagtatttaaaagttataatgtcgcggtttgtagattagaaaggattagaaattaattaatagagtaattttagaaaaggttatagttttggaatttttaggttaagatttaaattttcgtatcgtgttttattatggtgtttagtatttttgaagttatagttgtttagaatttgtgtttttattagtaattagggtataaaattaattttgtagattttagtaagtatttaaggtgttatatgtaacgtatttagtattagtaattataaaggatagtattagtatttatatttgtttaaattggaacgaaatttaaatttagtgaaaaggttgatttaagggagtaggtaattttttaaagatttttttataatagaagtatacgggaaattgattttttttatttttttattttttatttttttgatagggttttattttgtcgtttaggttagagtgtagtagtgtagttttagtttattgtaatttttattttttaggtttaagtgatgtttttgttttagtttttcgagtagttgagattataggtttttattattacgttttgatttttttttttttgagatagggttttgttttgttgtttaaattggttttaaataatttttttgttttagttttttaaagtgttggagttatagatatgagttatcgtgtttcgtggagaaatttatttttagtaaaattatttttatgtttaataagatggtttatagtggttatgtttggttgatttagttatatttaatttgttataggaataattttgataaagtgttttttgtattttttttatatgtaaagtaatttttagaaattgtttttagttgttattttattgagagtaatataattgtttgtttagtatttgttttttttttatggtaaattgtaaatttattgaaacgaagaacgattttcgtgattgttatattttttaattttggtatttagtagttttgtaaatattgtttaaatgattttttaagtttttagtttaaagttttttagtgtattttgtagtttgttgaaagaatttgtttggaggttaggttgattatttatttagattttatttgaattatatgttgttttgtgttatggtttgaattgtgttttttaaaatttatttgtggaagtttgagtattttagaatgtgattatttgaagatatagcgtttaaaaatgattaaattgaaacgaggttattaggataggttttaaatttaatttgattggtgtttttgtagaaagaggaaattgggttatagggagagattttagggatgataggtatagaggaaaggttttgtgaggatatagtgagaaggcggttttttgtaggtgaaggagataggttttagaagaaattaaatttgtttgtttttggatttttagtttttagaattatgagaaaataaatttttgttgtttacgttattttgtttgtggtgttttgttatggtagttttgagaaattaagatattgtgattttaggtaggtttttttattaatgaaatttttagtttttgttagtaaaattagaatgcgattaatattttgttgtttttgttgttgttgagttatttaagaattgatttggtaatggtgtataatttagtttgttgagtgaatcgttggtataggaggggtgggagtgttattggtaaagttgagatgtagaatgtgatggattttagaagagttgtttgagtttttttagtttgggagaagataagttggtaagtattttgggtgttgtattaatttggtttaatgatggtatatagttttttaatagtaatagtagtagggaaaggaattgttgtagaatttgatttaaataaatttttttttttttgtttgtgagttgggtaaaaataaatagttaatataggtatttgagtattgtaagtatttttaaaattaaagtaaaggttgggtatggtggtttacgtttgtaattttagtattttgggaggtcgaggtaggtagattatttgaggtcgggagttcgagattattttggttaatatggtgaaatttagtttttattaaaaatataaaaattagtcgggtatggtggtgtatgtttgtaattttagttattcgggaggttgaagtaggagaattatttgaattcgggaggcggaggttgtagagagtattattgtattttagttttggtaatagagcgagattttgttttaaaaaaataaagtaatatttttgaatatgaaatatttttttgaagaaatagtaattaaggggtgtatatgtgatttaaaaggaattagttttttaagatgttatttaaagggttttttttaaagattttgaatagtaaaatttatattttttggaataatagta

SEQ ID NO: 1041 - DNA, 6325 bp, Artificial Sequence
  chemically treated genomic DNA (Homo sapiens)
agttttttgagtagttgggattatagttatgtattattatatttatttaattttgtttatttttttgtagagataaggttttattatgttgtttaggttggttttgaatttttgggtttaagtaatttttttatttcggttattttaagtgttgggattatagatgtgagttatggtgtttagttttttttttggtttttgattgtgtttttgatagtcgtgagatggtgttgttttattaagtaatatgttttgttattatattataattttgtagttgttgggattttacgtaaaagtattttattttaatgttgttttaattttttttatggtattatatttggggggaaatttttttttataaataagaattttggttttgggtatttatagatggtatttaatttattttttttaatgtttttgtaaaatagatgtttttttttttttgttagttgaggaaataaggtttagtatggttaaatagtcggtttaggttatatagttaacgagggagaagttaggatttgaattcgagttttattttaaattttattttgttatcgtagtagaatttttatttattaaggttaaggacgtttagatggttttgtgtttttgtattttatttgaaaaatgtttttaaaagttggtagatgagttttaattgtggttttttatttttttttttatgtattttttgagtacgaggtttggttgaaggttagtttttaggtgtttagggaaagggttattttttttaaaatagtagtagtttaggttagagtttatagatgttttagttttacgtggtaagtttttttgggtttttatttgtatatggagtcgaagaggtttgttttttgatagagaaataaatttttagggtgttgagaatggtgataggatgaataggttgtaggatttttgttattaagtgatatttaatgttgatagtgagtgacggttttttcgggaggtgttttttagagtatatttcgttatattatttcgatagttatttttttcgtaagattgatataattattagttatttttatataaatgtaaaagtaaatttttttagtgtttttgggaaattttatgttgttatattttagaaaacgatgttgattttttggtattttgtttgatattgatattgaataagagtagtggaaagttagttttcgtgaagttttggaattattgtgatttcgagtgttagtattaaaagagtttatttaaatatttttggttacgtcgttagaaaatagtgtattggaggtaattttaaaatgttttgaataattttgtttttatttttttttgtttttggttatagtttagatatattttaggtttattgttttgtgggtgaagataagttgggaaatgtggaagagttttttatttatttattagaggttttatttgaatttagttgtgagtttgggttgggagcgtaggaagcggttgtgttgaatgtatagtatgaggggatggtggggtttttaggtgtgttttaaattttttgtatttatatagagatgaattttttttgtagtagtttttagtgaggaggtttaggattttaagttttgagggtttttgagtttgttataggttagggatagggatttggttgttgatgggtgatatgttgttagttatagaatggggttgattgggtattgggagtttggtgatggggtgttacggatatttttataggtttagttcgtgtttagaattatagagttgagtcgatgtatgttacggagaattgtttttgttttgtatacgtatgttgtattaggggtttgttttgggcggtttagttggtcgcgtttttgtttgtttagggtgagtttttgtatagggtttggttttgtggagtttatttggtggttaaagatggtgttgtagttttagttcgttcgtaggtttagtattttttgttttttagtttgttttaggtttttagattgtgcggtgtaaaggtttttggaggttagtttcgggttggttgtgaggggagagttaggtgtcgtagttttttttggtatagattttagttgtttttaggattcggggtttgaaggaggtagaagtcggcggtggaaaagggcgtacgttttttttagcgtcgttttcgttgttcgttgtttattgtagtttatttatttgtttttttagttatttttttagttttgggtcgggagagattatttttttttttttggagggatgagttaatagggttgagttttttattttttcggtggttagttcgttcgattattacgttttttttttttagggttttagttttcgggtcgcggttcgtttgtattttaaagttatataatgcgggcggtttcggcgaggcgggaggggtcggggtagagggagggttttcgtttttttatttttagtttcgttttcggagttcgcgatggagttttgtgaagatgtaggcgttggggttgttcggcgatgatgatattatcgtgttatatataggagtcggttgtcggggggtttaagagaagagtttttcggattatatcggcgtttacgtttatattcgtacgtttcgggtagagtcgcgtacgtcggttatattcgggcgcgcgtcggttatattcgcgcgtatatatacgcggcgttcgtttttcggttttcggttcgggtcgcgagtcgtagttttttgtcgtcgttttcgtcgttacggatgttcgtagttgtttttttttgtagtgtagtaatttcggtcgtcggtcggttcgtttcggttttcggttgtaggaatcgcgttaggacgttggtttcgttcgcggttagtttgtacgttagggtatagcgaggatgggagggtcgtagtttttgtagttagttttagttagcgatttgaatttggaggttttcgaggtaatgtaagtgtttcgttcgggtcgtttcgagtttttcggggaggaggagaggatgttcgggttttgttagtgtcgttttttttaatgtttgtgtaatttggagtttaggttggtttggggtttttcgtagttttggaaagttttatttggggttgttttgggaggagtatttggtagttttaagttattgttgtgggtagaaacgattttttggaatttagttttggtcgtttagtagtgggtgtatggttggggggttttttttgtcgttagtattttttttttgtattttcggtatagtggtattttttgtaagggaatagttaggtattagcgattgtttttttttaggaagaatttatgagcgtggtagtttcgtgttcggggcgatagtttagttttcgggtagttgcgtttgtggttgggtagatggcgtggtgcgttttggtggacgtttcgtttagttagtttaagtattatttatatattttggtgaatattcgaggataaggtcgtttgttattattagtaaagggtcgaatcgttttgttattggtggaggtagtgtttgattgtgtatcgatttaggaattcgatttttttttttaattatagagttaacgtgtttagaagtggtttttattttggtcgagtgtttattagaatttacgtttttgttatggtcgtttttattatttatttaggtatgtttggacgatggggcgtattgaatgggtttgtcggtcgggtcgtattttagtaatttaggtttgtatttaaagtggattttttagttttatttgtttttatttttttagagagaagattatgttttagagaagagtattttttggggatttgggggtaggggtagtaaagtgggtttttaagagttatggatgtgtagattaaaagatggtggggattgatttgtgtgttgtaggagggatggggtttcggggggtatttttttattggtttttcgatttttgggttttagtgaggagttggttcggcgtagtgatgtaatgttaggttgagtttcgtggttttttgggttttagttttttagtagggagttattttttcgagtaggtgtgtatttattatttgtttttatttttgtagtttgagaaagtatcgttttataatggaggtatatcgcgtttgaggattttttttttaaatgttatgatttttgtgttgtgtttgttttgttttttatgtacgtgtagtgttgttaggtgtatggaaatataattcgagtttaggtagaaaagaattattttaatttattttttgtaagtttttatagtggaattgagttaattagtgataggtattggttaatttttacggtttagatttatttagtgaagagtttaggaaatagaaaggataatgtgattgtacgtttgggaaaatgtgttttttagttattggaaatttagttcgtcggtttttaacgttttcgtttttttttttagttgagttaataaatgattagtgtttcgttagttgagggtcgagtttagatagtttttgttaggtagttgtgtttttttggataaggttttttaaggttttgtttattgggatagtggtgtttaaataaaattttaggttgaatggttatattgtgatggaagttgtttattaaatatttttatagttgagttggtttatatgttttcgtttgaggtttttttttttagaattgttgtttttgaaatgtttttaaatatagatttttacgatagtatatttatttatttataaaattttattttttatttcgtaatatttttgttttaaaaaaatggagagagaggaaatatttggggttagtgttattgttagtatttgttttttttaaaattcgtttttgttttttgaataattggggtttatttttttagtgtagatgtgtttttttttagtttagaggttttaaaaatatatattcggagagtgttttttttttgtttaggtataggttttttttggtagtatttttatgtagttaaaaatgtatgtacgtgaataatatataagatagtaatagagtgtggggtttatggtaggaaagaggttgtattgtaagatgatgtcgttagggttgtagggatggtgataaatatagggtgcgtatttgtcgcgggggatagtttttgataatcggaatttagagtgaatgtttttttttttttttgttggttttttgtgaaagattggtttaaggagggttatggtgtaagagtgaaattaaaagatagaggatttggaagtgattgaaggatttttttttaatttaaattttttagttttaagatttttttttttttaattgtaggtttggggtgtttttgggtagtttttgtagttttagttgatagttttattttatgtaggagtgtattgggttagggagggagcgatttttgtatttttttttttgagaatttaggtattaagattggagtagtagaagttttatgggattggggattgaagtttgaggatgaaggtgtaaatggtgattagttttttgttatttttagggtcggttatatatgatagtattagttttttaaaggggtttgttagaaacgtagagttttagattttattttagattagttgaattagaatttttattttatttagggatttgtaaagatgtttaggtgatttgtaggtattttaaaatttgagaagttatgagttggtttagttttttttttattttgtttatgagaaatagttggttatttttttgattgttttttttttatttggtaaagaagtttttgtagtaatagtgattatttgtttttaaatagaatatgagtagtaaggggagggagaatttttttatagaaaatatttattttttagtatggatggtaggagatataggaatggataggaagtatttgagtaaatgtgggttgtagttattgattagatttgttgtttattttttgattttgtggtagttttatgtggtgtggtttttgttaagtggggtagtattaagtattttgttttttatgtagttggagattttcgttttaggggtttttttagtttttattaaatttttatattttggttattgaaaattatttagggggttattattagagagtaaaagcggtggttttgttggtaaagtcggtttgtttcgattgttgttttatttttaaagtgagtacgtgtttttggttttaaaaaataaattataaatatggaaatttatattttgtagatttgtggatcgaagtagaggggttagggtggatgggagagaagcgatggaggaggaagtaataggttttgtgattgatgagatgggggagggaagagaagagatagtggtaagt

SEQ ID NO: 1042 - DNA, 6325 bp, Artificial Sequence
  chemically treated genomic DNA (Homo sapiens)
atttgttattgttttttttttttttttttttattttattaattatagagtttgttgtttttttttttatcgttttttttttatttattttggtttttttatttcgatttataggtttatagagtatgggtttttatatttgtgatttgttttttagagttaagggtacgtgtttattttgagagtagggtaatagtcggggtaggtcgattttgttaatagaattatcgtttttgttttttgataatggttttttgggtggtttttagtggttagggtgtggggatttggtggaagttgagggaatttttgaaacgggggtttttaattatataaaggataaagtatttaatgttgttttatttagtagaagttatattatatggggttgttatagaattaagggatgaatagtaggtttgattaatagttgtagtttatatttatttaagtattttttgtttatttttgtgttttttattatttatattgagaaataagtgttttttgtgggagaattttttttttttttgttatttatattttatttagaaataaatggttattattgttataagaatttttttgttagataggaaaggagtagttagagaagtggttagttgttttttatggataggatggagggaagattgaattagtttatggttttttaaattttgagatgtttataaattatttgggtatttttataagtttttggatgaaatggagattttgatttagttggtttggggtgaggtttgaggttttgcgtttttagtaagtttttttgggaagttgatgttgttatgtgtggtcgattttgggagtagtaagagattggttattatttgtatttttatttttaggttttaatttttagttttatgggatttttgttattttaattttgatgtttgagtttttaaaaggggagatataaaagtcgttttttttttagtttaatgtatttttgtatagaatgaagttgttagttggagttataaaagttgtttaaaggtattttaaatttgtaattggaaggaaagaaattttaaaattaaaaaatttaaattaaaaaaaaattttttagttatttttaaattttttattttttgattttatttttatattatggttttttttaagttagttttttatagggaattagtagagaaaaagggaaatatttattttagatttcggttgttaggagttgtttttcgcggtaggtgcgtattttgtgtttgttattatttttgtagttttgacggtattattttataatgtaattttttttttgttatgggttttatattttgttgttgttttgtgtattatttacgtgtatgtatttttagttgtatggaaatattattaagaaagatttgtgtttgggtagaaaagaggtatttttcgaatatatatttttaaaatttttagattgggaaagagtatatttgtattagaaaaataagttttagttatttagagagtagagacgggttttgaagaggatagatgttagtaatggtattggttttaaatattttttttttttttatttttttagaataaaaatgttacgggatggagggtgggattttgtgaatgagtgaatatattatcgtaaagatttatatttagagatattttagaggtagtagttttagggagagaagttttaggcgggggtatatggattaatttaattgtgaaaatatttgataaatagtttttattataatgtggttatttagtttgaaattttatttaaatattattattttagtgggtagaattttaagggattttatttaaaaaggtatagttatttaatagaagttatttaaattcggtttttagttgacggaatattgattatttattaatttagttgaaaaagagggcggggacgttagggatcggcgagttgaatttttaatgattgaggagtatatttttttaaacgtatagttatattgttttttttgttttttaagttttttattagataggtttgagtcgtgagagttggttagtgtttgttattgattaatttaattttattatagggatttgtaaaaaataggttaaagtggtttttttttgtttagattcgagttgtatttttatgtatttagtaatattatacgtgtatgagaaataaggtaggtatagtataaggattataatatttaaaaagaaaatttttaaacgcgatgtgtttttattgtaagacgatgtttttttaagttataggggtgaagataaatgatgggtgtatatttgttcggaagaatgattttttgttaaagagttggagtttagaaaattacgaggtttagtttagtattatattattacgtcgagttagttttttattgaagtttaggggtcgagggattagtgaggaagtatttttcggggttttattttttttataatatatagattaatttttattattttttaatttatatatttatgatttttaagaatttattttattatttttatttttaagtttttagaaaatatttttttttgaaatatagttttttttttggaaaagtgggggtaggtgaggttgggaggtttattttggatataagtttgagttgttgaaatgcgattcggtcggtagatttatttaatacgttttatcgtttaaatatgtttgggtaggtaatggagacgattataatagaaacgtgaattttaataaatattcggttaggataaaggttatttttgagtacgttagttttgtggttgagagaaaagatcggatttttggatcgatgtatagttaagtattgtttttattaatgataggacggttcggttttttattaataatagtaagcggttttgttttcgagtgtttattagagtatgtggatgatgtttaggttaattagacggaacgtttattagagcgtattacgttatttgtttagttataagcgtagttgttcggaaattgggttgtcgtttcgggtacggagttgttacgtttatgggttttttttaggaggaggtagtcgttgatgtttggttgtttttttgtaggaaatattattgtgtcgggggtgtagaggaaagatgttgacggtaggagaagttttttagttatgtatttattgttgagcgattaaaattgaattttagggaatcgtttttgtttatagtagtaatttggggttattagatgttttttttagagtagttttaggtaaagttttttaaggttgcgaagaattttaggttagtttgggttttaggttgtataggtattaggaaaggcgatattaataaagttcgggtatttttttttttttttcgggagattcggggcggttcgggcggagtatttatattgtttcggaagtttttaggtttaggtcgttggttggggttggttgtagggattgcgatttttttattttcgttgtgttttggcgtgtaagttagtcgcgagcggggttagcgttttggcgcgatttttgtagtcgggagtcggggcgagtcggtcggcggtcggggttgttgtattgtagaggggagtagttgcgggtattcgtggcggcgggagcggcggtagggagttgcgattcgcggttcgagtcgggggtcggggggcgagcgtcgcgtatgtgtgcgcgcgagtgtggtcggcgcgcgttcgagtgtggtcggcgtgcgcggttttgttcggggcgtgcgggtatgagcgtgagcgtcggtgtggttcgaaaggttttttttttaaatttttcggtagtcggtttttgtgtgtgatacgatgatgttattatcgtcgagtagttttaacgtttgtatttttataaagttttatcgcgggtttcggaaacggggttgggggtggggaggcgaagattttttttttgtttcggtttttttcgtttcgtcgggatcgttcgtattgtgtagttttgaaatgtaaacgagtcgcggttcgggagttggggttttagaaaggaggggcgtggtggtcgggcgggttgattatcgagagagtagggggtttagttttgttggtttatttttttaggaaggaggaaatggtttttttcggtttaggattaaggggatggttggaggaataggtaaataggttgtagtgggtagcgggtagcgggagcgacgttgggagagacgtgcgtttttttttatcgtcggtttttgttttttttaggtttcgggttttggaggtagttgaagtttgtattagggagagttgcggtatttggttttttttttatagttagttcggggttagtttttaaggatttttgtatcgtatagtttgagggtttggggtaagttagggagtaaaaggtattgggtttgcgagcgggttggggttgtaatattatttttggttattaaatgagttttataaagttaagttttgtgtaaaggtttattttaaataagtagaggcgcggttagttgagtcgtttaaggtaggtttttaatgtagtatgcgtgtatagggtaaaggtagtttttcgtgatatgtatcggtttagttttgtgattttaaatacgggttgggtttgtaggaatgttcgtgatattttattattaagtttttagtgtttagttagttttattttgtagttggtagtatgttatttattagtagttaaatttttgtttttggtttatggtaggtttagaaatttttaagatttgagattttgagtttttttattggaggttgttgtagaaagagtttatttttgtataggtataggaggtttggggtatatttgggaattttattatttttttatgttgtatatttaatataatcgttttttgcgtttttagtttagatttataattgaatttaaatggaatttttgatgggtaagtggaagatttttttatattttttagtttgtttttatttatagggtagtgagtttaaaatgtatttaaattgtggttaaaagtaaaagaaaataaaaataaaattgtttaaagtattttaaaattgtttttaatatattgttttttagcgacgtggttaaggatgtttggatgggtttttttgatattgatattcgaggttatagtagttttagagttttacggggattgattttttattgtttttatttagtattagtgttaaatagaatgttagaggattaatatcgttttttgggatgtaatagtatgaaattttttagaaatattgagaaggtttatttttgtatttatatgaaaatagttaatgattatgttaattttgcggggaaggtggttgtcggggtggtgtgacgaggtgtgttttggaaagtatttttcggggaagtcgttatttattgttagtattggatgttatttggtggtaaggattttgtaatttgtttattttgttattatttttagtattttgggggtttgtttttttgttagaaaatagattttttcggttttatatgtaggtgagggtttaaagaagtttattacgtggagttgaaatatttgtaagttttaatttgggttattattgttttgaagaaagtggttttttttttgggtatttaggaattggtttttagttaagtttcgtatttagaaaatatatgaggaaaaaaatgaggaattataattagaatttatttgttaatttttaaaaatattttttagatgaggtgtaaaagtataaagttatttaaacgtttttagttttaataggtaaaggttttgttgcgataataagatagggtttgaaatgagattcgagtttaaattttgatttttttttcgttagttgtgtggtttgagtcgattgtttaattatattgaattttatttttttagttggtaaaagaggaaaagtatttattttgtaagggtattggaaaaagtaaattaaatattatttatgaatgtttaggattaggatttttatttataagaaaaaatttttttttaagtatagtattataaaggaaattaaggtagtattaaagtgaagtgtttttacgtagaattttaataattgtaaagttatgatgtagtgatagggtatattatttagtgggataatattattttacggttgttaaaaatataattaagaattaggagaggggttgggtattatggtttatatttgtaattttagtatttggggtggtcgaggtgggaggattgtttgagtttaggagtttaagattagtttgggtaatatagtgagattttgtttttataaaaaaataaataaaattaggtgggtgtggtggtgtataattgtggttttagttatttaggaggtt

SEQ ID NO: 1043 - DNA, 6214 bp, Artificial Sequence
  chemically treated genomic DNA (Homo sapiens)
ttgacgagaaaagatttatatatttagtgggtttttggtttttttttttttgtttgaggttttgagtattattttgggaggagagaggaagtaattttaaagttgagtgagttcggagtttttatggtattttggagttatttttagaataggggaagttggtattttattttttggaaaaggggtgttagttagttgttattattatatagttttgtgatttttatagttttttttatggaggttttttatttagggaagggaaatttaggttttttggaaggagagggaagaggaataggtgttatatagggatgttgaagggttgagaggtatagtatggaagtggggagaaaagtttgagtagaggtttttatttttaatatatatatattgagtgggaaagggatattttttttttttttttttttttttgagatggagtttcgtttttgttgtttaggttggagtggaatggcgttattttagtttattgtaattttcgttttttaagtttaagtgatttttttgttttagatttttgaatagtttggattataggcgtttagtattatgtttggttaatttttgtatttttagtagagatggagttttattatgttgtttaggttagttttaaatttttgattttaggggatttatttattttggttttttaaagtgttgggattataggcgtgagttatcgtattcggttagggatatttttttttttatataggtatagataggtatttatatatatataaatatatatatatatatatatatatatatacgtatatatatatataaggataaatatgttagtatatagttaaatatatttataggtaatattttttggtatatatatagatatatatatatatatattgtttaaagatatatttttatgtatttttatagttataataagtatgtgtgtaatgaaaaggtatatgtttgttttatatatatattattattaaataggaatatataaagaggtatttaaatatatatataagttgttattttttagtgtatatagaggtttaggtgtattagatatttatagagatttattgtttatagttatatatatatatagatgtatatatatagatgtatatatttaagtagggatatatatcgtttttttttttttatttattggggttttttgaggggaatttgtatttatattttttttttttttttttttttttaggggtaagatagatttcgtttaggagagattataattaggtaaaggggtttttggtggtaatgtaggggaggggtagaggttaggagtagtaattttgttaggtaggtttcggaagtttaacggggttttagcgtatattcggtgtagttttaatttaatgttattttagtatttatcgttgttcgtttagagttgagatcgaggagagatagaggagaggttgggtttagttgagttgtgaaggtagcgcggttttcgtttgttttaggttcgttcgttttttagtttttttttttattttttacgcgtcgtttaggtaacgttaattttttttatttttcgtttttttttagggtttagagtttcggaggttgttagttttttttgtcgttaggttttcgttgggttttttcgttaatttaagattcgttttagataaggaggagggcgtatggaatttttggttttattttttagatttttacgtgttttattttatttgtgtttacgtttttttcgtttatcgttttttgagttatacgtaaggttcggttgtatacgcgtgtttcgttttagattttacgcgtgtttttaggaggttgttatatgatttgttatatgttatacgcgttttcgtttttacgagtacgcggtcgcgttaagtatacggtatgggtgtagattggattcgttttttaaatttaggagattattaattatggaaaggagatttagggaatatcgttttgaattcgttaggggttttgagtttcggatttaggagatttaattttgattatttttttaggatgtagtagggggatgttaaattagattttaggaagaatttttttgttgtttgagttaggtgtcgttacgtttgtttaggggtaagaggttagacgggatgaattagggatcggaagacgtgggggatcggtaatttttgtgtttttggttagggtagaagggggttttgttattttaagaaagagtcgttggagttattatggtaattattttttttgggagggttagggcgggtagatggtgatttcggaaggaagaaggggtttgttcgggtagttagggggcgcgaggacgtgcgaggcgggggcgcgcggggtttatcgcggggaggggcggcgcggatttcgcgtggtgttgaaggggatagcgttagatttgtcgtattgcgtaggcgtagaggcgcgaataaagaggggagggggacgaggcgcgcggtcggaggtggtgcgcgtttacgtggttttatttttgtaggggtttgtttttttagttattttttttttaagtaggttgaggaagaagagatagtaagtttttatttaatttgattttttttttgttttttttcgttgttagttttttttttttcgttgttttgcggggtggggaaacgtggaaggaattttgggaaaattagatgtttgggttttttattttcgtttggtttgattttggataaggggttttttttttagggtttcggtttttttatttttaaaatggattgatagtatagatttgtttattttttagaggtgttcgaagttttgacgagataatagatgagaagtggttttcgttgtgatgagttagttgaagcggttgtatcggagcgttagatcgttagcggtgtagtggttttcgcgttttttatatttttttatatttatttcgtggatgatgggggaaggtattatttttggggtttttcgaagcggattttgggattgggatttggggacgcggtgagaggtagttttgaagttgagtttagaggtttggggcgttattgttttagggcggatttagttttagattttataattaaatttaaggttagtcgagaagtattattattggcgggttgagttgagtttttattttttttaggattttggatttttggaggaaatgaaagggatttagttggaaatatagttttttttcgcgttttttatatttttttttttcggcggaaacgcggtttaaattgttacgaagtggaagaggttggatagttttttataattaattaggaatgggaggtttgagtaggtttatttgatgagggaaatattatagtttcgttaatttatttattattttaataattatttattgaatatttgttacgtggtagatagtaagagtttggatagttttttttcgttttttaaagtcgttaaacgcgattagagggtagaggagaggtcggtaatttaagagttttggtttcgtttttttcgcgtttggttttgtttgttttttttattattatttcgtttagaggcggttattggtttaagaggacgatagaagttagtttttgatgtttatcgtattttttagttttaggttttaagttttgtagtcgagaaggcgaggtttaatgttatattatcggtttgtttcgttttcgtttcggggtttattcgaaaagtttttagatcggattttcggtgagacggtattcgattaaataggtttgtttttataggttaaggaggcgggtttggtgcggttattttaaggttaaagcgagaaaattttattgcgtacgcgtaatagatagtcgatggagttatcgatggagtcgttcggaggggagtaagagttcggagtcgttaggtatcgagtatcggaggggtcgagagggaagaggaatttgagggaggggagtcgagtcggggttgggtttgggggtcgtttttgggagttggggcgtaggaatataacggaggcggattcgtaggtaatagtggtttcgggacgttagtgttaacgtttttttattcgtaggtttttggatttgttttgggaagacgtgttgtttttatacgttttgaatcgggtttcgttgcgttagttgtttcggttgtagcgcgttagtcgggtttttcggtcgttggtgtagttttatttggtcgggttgcgtcgtttcgatgtcgcgtaggtgagtcgggggttgaagtttcgtttttgtttgggtatcgtttcgtttttagtttagtttttagtttcgtagtatgtttttttggatttttttgggtcgtcggggttgttcggaagggatttacgtattaaagggtaaatattcggtagcgatttagagggaaagtggggttttttttgggagagtaggaggttgttagaaaagaatttaggttaggggtgtataggcggttgaggagtgcgggacgggttgagagttggggtgttttttcgttcgtaggtgggttcgtagatttcgcgggtcgtattggttcggttgttgcgggatgtcgaggggttgtaggagttggtattggcgtcgtgttacgaatggttgttagacgaggatttggtgtcggtgttggcgcggaattcgtagttgcggagtgtggcgttgggcggttgcgggtaattgagtcgtcgggcgtttggggttttggtcgagggttgtttacgtttgtagcgtttgtcgttcgcgtattgtgattgggtggacgggttggcgttgcgcggtttcgttgatcgttgttcggttttggaggagttggattttatcgtttgtcgttagtttaaggacgaggttatcgtgtatttggcgtagaggcgcggcgttggttttcgtagtttttttttggtcgttaacgttaacgtgggggacgtcgcggtttaagagttggttcggaattgtttagaattttattattttgattttatcggttgttttcgcgtcggaagcgacggtgttaggtgtttgggtttgatagggcgggaggagggtagttatttagtttttgttggtatggggcgggttgtagttgttaaaaggtcggattgagggttttgaatttttttgtaaattatagtatttttattttgaatagaaagggtttttaggattgtttaggttagagagtttatagtttaaaaattttttttaattaatgtttatatattgggagattttatatagaaagtcgatttttggtttttttttaataagggggagattttgtaattttaggcggagttgagggttaggttttttttttaaatgagataggaagtttttagtttattggaagttaatttaggcgttttttttgtgtagggacggaaaaagtatgtttttgtttcgagttggagggagatcgggattttgtcggagttagttcgaggttgagtgagttcgggtttttattttattttattaaaggtgtggtggttttatgtttttagttttattttgttttttttttaggatattggtcgagtattgtttcgtgttgcgttcgttgcgggtgcggtattgttattatgtggcggagtttagtttgagtcgtttgcggaagcgcggcgtggatatcgacgtggagtcgtcgttgtattaggttttggtgttgttgtaggatatggcgggtttcgtattttttgttaatttgtaggtttgattcgtttgttaatcggagtatagttggattgtgtggttggggtttgatattgagttgtagggaaattgaattgtgaggatttttggtgagaggttagtgttttgttttattttggagttttaaataaagagttttttatttttttttgtttggtgttgttttgttgaagataggggattcgaggttggggaggaaaggttagataggtatagtattttagttttgaggtagaaatgattagaatgtatttatattttttttgggttatttttattgtgtttatggaggtagtttcgagagtaggttaatattatggagtaaaggagtagagaagggggataggagttagggggtttttgtgtaggggtatagggtttttgtatttttttgggatttgagtttagaaggttcgggtagagttcggcgagtgttttaatggaagcggtattttttggttggtttgaggttgatgtatgtggtttttattttttcggttttagggtttcgtata

SEQ ID NO: 1044 - DNA, 6214 bp, Artificial Sequence
  chemically treated genomic DNA (Homo sapiens)
tgtgcggaattttgaggtcgaggagatgaaggttatatatattaattttaagttagttagaaagtatcgtttttattgaggtattcgtcggattttgttcgagttttttaggtttagattttagagggatgtaggagttttatatttttatataggggttttttaatttttgttttttttttttatttttttgttttatagtgttaatttattttcggagttgtttttatgggtatagtaaaggtggtttaaggaaggtgtgagtgtattttggttatttttgttttaggattgggatattatgtttgtttgattttttttttttaatttcgaattttttatttttaatagggtagtattaggtaagagggggtaaaaagttttttatttgaagttttagggtggggtagggtattggttttttattagaggtttttatagtttagtttttttatagtttagtgttaggttttagttatatagtttagttgtgtttcgattggtaggcgggttagatttgtaggttgataaaaggtgcgaagttcgttatattttgtagtagtattagggtttggtgtagcggcggttttacgtcgatgtttacgtcgcgttttcgtaagcggtttaggttggatttcgttatatggtggtagtgtcgtattcgtagcgaacgtagtacggggtagtattcggttaatgttttgagggaggagtagggtgaggttagggatatgaggttattatatttttggtggggtaaggtggaggttcgggtttatttagtttcggattggtttcggtaaaatttcggtttttttttagttcggggtaggggtatatttttttcgtttttatataagggaggcgtttggattggtttttagtgagttggagattttttgttttatttaaggggggaatttggtttttagtttcgtttaggattgtaagattttttttttgttgaagaaaagttagaagtcgattttttatgtgaaattttttaatgtgtaaatattggttgaaaaaagtttttaaattatgggttttttggtttaggtaattttagaggttttttttgtttagaatgggggtgttgtggtttgtaggaagatttagaatttttagttcggttttttaataattatagttcgttttatattagtagaggttaagtgattgtttttttttcgttttattaggtttaggtatttgatatcgtcgttttcgacgcggaggtagtcggtgaggttaaggtggtggagttttgggtagtttcgagttaatttttgaatcgcggcgttttttacgttggcgttgacggttagagagaggttgcggagattagcgtcgcgtttttgcgttaggtatacgatggtttcgtttttgagttggcggtaggcggtgagatttagtttttttagggtcgggtagcgattagcgaggtcgcgtagcgttagttcgtttatttagttatagtgcgcgagcgataggcgttgtaggcgtgggtagttttcggttaaagttttaagcgttcggcgatttagttgttcgtagtcgtttaacgttatatttcgtagttgcggatttcgcgttagtatcggtattaggttttcgtttgatagttattcgtgatacggcgttagtgttagtttttgtagtttttcggtatttcgtagtagtcgggttaatgcggttcgcgggatttgcggatttatttgcgggcggggaggtattttaatttttagttcgtttcgtattttttagtcgtttatgtatttttgatttgagtttttttttggtagttttttgtttttttaggagagattttattttttttttgagtcgttatcgagtatttgttttttggtgcgtggatttttttcgggtagtttcggcggtttaagggggtttagaagggtatattgcggggttgggggttgggttagaggcggggcggtatttaggtaggggcggggttttagttttcggtttatttgcgcggtatcgaagcgacgtagttcggttaggtgaagttgtattagcgatcggaaggttcggttaacgcgttgtagtcggagtagttggcgtagcgggattcggtttaggacgtgtgggagtagtacgtttttttagggtaggtttaggaatttgcgagtaaaggggcgttggtattggcgtttcggggttattattatttgcgagttcgttttcgttatgtttttgcgttttagtttttaagagcggtttttagatttagtttcggttcggttttttttttttaggttttttttttttttcggttttttcggtgttcggtatttgacggtttcgggtttttgttttttttcggacggttttatcggtggttttatcggttgtttattgcgcgtgcgtagtaagattttttcgttttggttttggagtggtcgtattaaattcgtttttttggtttgtagagatagatttatttaatcgagtgtcgttttatcgaggattcgatttgaaagtttttcgggtggatttcgaaacggaggcggaatagatcggtggtgtaatattaggtttcgttttttcggttatagggtttgaggtttgaagttggagaatgcggtgggtattagagattggtttttgtcgtttttttgagttagtagtcgtttttgagcgaagtggtggtgggaggagtaggtaaggttaaacgcggagggggcggagttaggatttttaggttatcggttttttttttgttttttggtcgcgtttagcgattttgaaaaacggggagaaattatttaggtttttattgtttgttacgtagtaggtgtttaataagtaattgttgaaataatgaatgaattggcgaggttataatgttttttttattaagtaaatttgtttaaattttttatttttgattaattatgaagagttatttagttttttttatttcgtaatagtttgggtcgcgttttcgtcgggggagagagatgtagggggcgcgaagaaagattatatttttaattgggttttttttattttttttaaaggtttagagttttaagaagaatgagagtttagtttagttcgttagtggtagtgtttttcggttggttttgggtttagttgtagggtttggggttgggttcgttttgggataatgacgttttagatttttggatttagttttagggttgttttttatcgcgtttttaggttttagttttaggattcgtttcggggaattttaggagtagtgtttttttttattatttacgggatgggtgtggggggatgtgaaggacgcgagagttattgtatcgttgacggtttggcgtttcggtgtaatcgttttagttggtttattataacgaaaattattttttatttgttatttcgttaaggtttcgggtatttttgaaaggtgggtaggtttatgttattagtttattttaaagatggggaaatcgaggttttggagaggaagttttttgtttagaattaagttagacgggaatagagaatttagatatttggtttttttagaattttttttacgtttttttatttcgtaaggtagcgagaagggagaagttagtagcggggagagataagaaaggggttaagttaggtgagggtttgttatttttttttttttagtttgtttagggagggggtagttgggaggatagatttttgtaaagatagagttacgtgagcgcgtattattttcggtcgcgcgtttcgttttttttttttttttgttcgcgtttttgcgtttgcgtagtgcgataaatttggcgttgttttttttagtattacgcggagttcgcgtcgttttttttcgcggtgagtttcgcgcgttttcgtttcgtacgttttcgcgttttttgattgttcgaatagattttttttttttttcgaggttattatttgttcgttttggtttttttaaagagagtagttgttatagtaattttagcggtttttttttaaaatagtagggtttttttttattttggttaagggtataagggttgtcggttttttacgtttttcggtttttagtttatttcgtttaattttttatttttgggtaggcgtgacgatatttaatttaggtagtaaggaagttttttttgaagtttgatttaatatttttttgttgtattttgggagggtggttagggttggattttttgggttcgagatttaaaatttttggcgggtttaagacggtgttttttagattttttttttatagttgatggttttttggatttagggggcgggtttagtttatatttatatcgtgtgtttggcgcggtcgcgtgttcgtgggggcgggagcgcgtgtggtatgtaataggttatgtggtagttttttagggatacgcgtggggtttggagcgggatacgcgtgtgtagtcgggttttacgtgtggtttaaggggcggtgggcgagagagacgtggatataagtggggtggggtacgtgagggtttggggaatagaattaggggttttatgcgtttttttttttgtttggggcgggttttaggttggcgggagagtttagcggggatttagcgataaggggggttggtagttttcggggttttgggttttgggagagggcggggggtgggggggattagcgttgtttgagcggcgcgtagggggtagggggagggattgagaggcgggcgggtttggagtaaacgggagtcgcgttgtttttatagtttagttgggtttagttttttttttgttttttttcggttttagttttgggcgagtagcggtgagtattgaggtggtattgagttggggttgtatcgggtatgcgttgggatttcgttgagttttcggaatttgtttggtagggttgttatttttgatttttgttttttttttgtattgttattagaggtttttttatttggttatggttttttttgggcgggatttgttttatttttggggagagagggagaggagaggaatatgggtgtagattttttttaagagattttagtaggtgggggggaggggacggtgtgtgtttttgtttgagtgtgtatatttgtatgtgtatatttgtatgtgtatgtgattgtgagtagtaggtttttgtgagtgtttgatatatttggatttttgtgtgtattggagaatgatagtttgtgtatatatttgggtatttttttgtgtgtttttgtttgatgatggtgtgtgtgtaaaataagtatgtgtttttttattatatatatatttgttatgattgtgagagtgtatgagggtgtgtttttgagtagtgtgtgtgtgtgtgtgtttgtgtgtgtgttagagggtgttgtttatgaatgtgtttaattgtgtattgatatatttgtttttatgtatgtgtgtgcgtgtgtgtgtgtgtgtgtgtgtgtgtgtgtttgtgtgtgtgtaggtgtttgtttgtatttgtatgaagaaaagaatgtttttggtcgggtgcggtggtttacgtttgtaattttaatattttgggaggttaaagtgggtggattttttgaggttaggagtttgaaattagtttggataatatggtgaaattttatttttattaaaaatataaaaattagttaggtatagtgttgagcgtttgtaatttaagttatttaggagtttgaggtaggagaattatttgaatttgggaggcggaggttgtagtgagttgagatagcgttattttattttagtttgggtagtaggggcgaaattttattttaaaaaaaaaaaaaaaaaagaagaatgttttttttttatttagtatgtatatattgggggtaggagtttttgtttaggtttttttttttatttttatgttgtgttttttagttttttagtatttttatataatatttgttttttttttttttttttttaggaggtttgagttttttttttttgagtgaggggtttttataagagagattataggggttatagggttgtatgatggtgatagttggttgatattttttttttagagggtggggtattaattttttttattttagaagtagttttaaagtgttataagaatttcgggtttatttaattttgaagttgttttttttttttttttagggtgatgtttagggttttaggtagaaggaaaggagttaggggtttattgggtgtataagttttttttcgttag

SEQ ID NO: 1045 - DNA, 6323 bp, Artificial Sequence
  chemically treated genomic DNA (Homo sapiens)
tgtgtaggtgattggggtgaagagaggttggcgaaatgggtatgagtatgtgggtagatggaaggaatacgttttaaagttttatggtagattagggcgattagaggtaataacgatgtattagagtgtgtttttaaagagttggaagatagtatatgagttgtttttaataggtagagatgatagatatttattggatggatatttatagatattgtataattttttagttgattatggattattacgtaatgtataagtattattatatgttataggaattttattaatattatgtttgtatgaagaaaaatatagttatgttataagagtgattgttatagttttttttttttagcgttatagttcgtggtttcggttttttaagttttgttgttatttttattaaagtcgttgatattcgtggagtttaattagggatttcgcgtttagggtttggtatgttttggaaaagttagtgagtttgttggtatgagtggttttggcgggtggtttaattattaggcgtagattttttttagtcgagagagaagtggttttttagttattcggtttggattggcggaagtcgttttgttttatattattggagtatttcgtggttagaagagagtgcgagggtgttgttggtggtggtggtgggttatttggcgataattcgaggagaaagtttgatttggttagtgggtttggtcgttgagaaatagtggtagcgaggtgagtatatgataaggaagagttgtaaagtcgatgttgcgaaggtggcgttagttaggttaaaaggatagatgggtggaggtaggtagtatattttttaaatatcgtaagttttttttttcggcgtataggtacgtagttataggttaagttgcgacgcgagtttcgcgcgcgggattttcgtaaaaggttcgttcgatgcgttgggcgggaatcgagttcgggttaattgtttggaaggtaattatgtttattattatattattaacgtcgtacggcgcgggtagtttcgtcgcgtcggttcggggtttttattagcgcgtcgtcgacgttcggggtaggtcggtttcgacgttcggttcgttcgttcgttcgtagtttcgcgttgtcgcggtttttttaaaggtcgtttcgcgttttatcggtgtaaggttagcgcggttgattcgttacgttcgtttgtttttgggggcgttttcgtttattcgtcgtttcgggtttttagagtttttttttaataggtgttcgggggggaaacggtcggcgtcggtagggtttttatttttacgttttttatcgggcgtagggtttcgtgtgtcgtagaaagtttttttcgataattattttgagtcggtagttcgttgggcgtcgtgtagggttagaggaggtttttcggttgtcgttattaagtcgcggacgagaagaaaagataggaggttaaggaggtttagaaggttaaagggttaggtaggttaggttcgagatggtattttgcgattagttggagggcggaggaaggagaaggagggtttataggttgggttcgaggcggcggtttaaaaagtacggttgttttttcgtcggggaatcgaatttcggtttttcgcgtgataggcggggatatttattattatattaacgaggacgacggcgacggtcgtcgggacgttagattttatttcgatcgcggacgtttagttttgttttgattttttttttcgacggtaggggtcgggcgcgtgttcgttttttattcgtcgttcgtcgttcgttattcgttatacgttattcgttatttgttattcgtttttcgttatcgttggtacgatttatttcgatatttaataaagtattttgcgatttcgttgggattcggagtcggagtcggatttcgataggtatcggagcggcgtggaattttttcgcgcgttttgtttgttgtttttaacgcggggatcgcgtcggggtaggaggaggcgcgggcgaaatagttaggtcgttgtttttaggacgcggtgggcgtacgttttgcggggttcggcgagcggaggcgcgggggttggggcgtgcgtcggcggcggtcggttcgacgcggattttttgggttcggggtggggacgcgggggcgtttacgttaacgttagtcggtttcgtttatttggcgttcgtttttttcgcgcggttcgtcggttgcgtatcgaatttagataggcgtcggttaagggcgtaggcgttcgcgtcgggttttagttatgttagcggcgaagcgtttcggcgcgtcgttaggatggtcgagcggtttaaggcgttgcgtttaggtcgtagttttttttggaggcgtgggttcgaattttatttttgataagtcgattttttggttcgttcgtcggagggtaacgtttatggtaattttggagtatttttggtcgttttttgttttgagtttttgttcgttttttagattttagtttttttgaagtaagtttttaaaacgtcgtcgttttttaggtacgttcgttttttttgtttattcgtcggttgtcgtagaaatagtttaggattatgcgttagcgttcgcgattttttattaattgtttttcggatagacgttttttttattattttatacgtttttttttttggttttatatatagcgagcgatcgcgattattttttacgtttttttttgtttatttttttcgttcgttttttttttattcgtttaaatagatatagtttagattttttttttatttttttttttttttttttttttttatcggttttcgtttatcgtttatcgttttgaatcgtcgttgcgttgtttagaggcgttttggtttgaatagttcgttcggttttattttttaatttttgatcgttgagtagtagcgagcgattcgttcgtggagtcgtatatacgttttttattagaggtacgttatttaatattttgttttttttttcgatttttcggatttcggtcgcgtattttattttgtcgatattttagttaggtcgtcgattttatttcgttatttgtgtttttttttcgttaatatttgtttgtcggtttatttgtagttcggacgtttgtcggttagaggtagcgggaattttgtatatagtcgggtaggcgagtttaaattcggaaagatagtttaagaggaattacgagcggaagttttagattttcgttattcgtttataaacgtttggtttcgtcgggattagttttgcgttatagcgtatttttacgcgggaagtcgcggtttgggtcgttttagttatatttagcgcgttttttttagggttagttagttgcggttttgtcgaagcgttttttcgtttttttttcgcgttttagtttttttattagtttagggggtcggattttaagtgcgagtcggtggcgtgggttagagcgtaggagcgaggcgtttacggatttggtttgcgtttttgagtcgtacgttacggttgcgagattcgttttttatcgtcgttttcgttcgttgatatatttatttcgttttttatttgttggtgatataagtgagaaggttggttttacggtggtgaaaaaaaaaaatattatacgaaagaaagaaagaaagaaagaaagaaagaaagaaagaaagaaagaattttcgtttgttacgcgggaggttcgggttcgattttcggtttatgtagtacgtttttttattttggtgttgtagtagtattaaggcgtagttgcgttcgtttttgtcgtttttttatattcggggcgcgcgagcgagttcggtatcggttgcgtttttacgcgcgacggttttttgttttttttttcgtgtttttttcgattgatttagggatgagtttattttacgtatttatatattttggtgataataatttttttagatacgagagcgcgttagatattagaatttggtagttttttggttttgtttttttttattgttttgttatcgtttttgttcgacgtattttattttacggaatatcgttaggtattacgggtttgtagttattcgtattattttttttttttatattttatcgtttcgatttttttttttttttttttttttgttttttttttttttttttttcgttggttttttatatttagaaaatgatgttatggttgtttttttagtaggaaggaagtcgcgattttagggagtaatttattatttttttttagttggttatatagtttttaacgcgattatacgagtgtacgcgtggtatgtgtatcgtttatatttatcgtgtttcggttattttatattttttttttttattttgtcggtattattatcgttatgtcgtaatttttaatttaattttaatttattattttagtcgaggatgttgttttgtttttttttttcggatttttttttattttagttttagatatatgtttgagacgtgaatgtgcgttttgaagacggtttatttatgtttcgggtttagttgtattttttatttttttgggacgtgggacgtggtttttagtcgttttgttacgatgttttttttattttgggttgtttgttattttattttagttttattttatattttgatcgtttagtttaagtagtattttagtttcgtcggcgcgggttttttttgattatatagatttcgtttttgtttagattaatcggttgaaaatgtattgtttttattagtttttaggtttagtttttttttttttatttttgttttacgttatttatttttttatttatatatatattttgacgcgtatatatatatatatatatatatttttatttttttttttttttattttttgtttttttttgtttttttttttttttttgtttttatgtttttatttttttgtttttgttttatatagttaatttttcgtttcgtcgttaatgttttttttttagacgatttatattttttagttttggttttttttagtttttttagatttacgttagtttcgttattagttgggattttttcgatttatggtataggtagttcgcgaggtgttttaacgttttaggtatttgtataattttcgtttgattgtatagttttatttttagatttggttagttagttttgtgtattttttggatattttggatttttttttttagtttttagtacgcgatatgttttttttttttttttggtgttagttttttgtttcgggttagggtggacgttagttacgggatcggatattttttttcgtcgttgttatttattgatatttatttataatacgttggtaagtaagttagtttttcgtggggatggtaaatatttttattttcgatagggtttggtttttgtaggtgattcgattgtgttaagattttacgaatgatacgggataggtttgtgtagttggttggacgtttattttgtttttatagaggggttttggtaagaagtcgattgatttttgttattgatttggggaattagttaaataataagattagtacgggttgaatagagggttgtagaattgggtttatttgtgttaaggaggggaggggaaaaaaagttttatagcgaattttggcgttggggataggtattatttttatatgttttttgatatttggagagacgatagagagcgtaggttaggtaatgggaagtaaatttcggttagaagtttgttaggaattttaatttcgtatatgcgttttggttagtttggtcgttgggttttttttacgaattgttgtatttttacgttttaatgttcgtggttaggttggtttgattaatgggattttttaagatttatttttatatttagaataggcgagaattttaaatttgtcgacggtgagcgggagtatgtgtacgtatatgtacgtgtacgttgcgggaagttagggatttcgaacggagggagcggttggagttgcggtcgaggtacgtaaattgtgaggattttattttaatacggatatttattagtttttaaataatgtttttataattttttacgtttgtttttattttaattttttaattttgttattttcgtaagttgaggatgtacgttattttaggatcgttgtgataattgtgttgattttataaattgatggtaaaacgtgtgtgtttgaatagtatgaaattagggtattttgaaaaagaatagaataatagcgatttttagggaataggggaagataacggtaaggtttgattgtttgcgaggtcgggtagaaagagttatatttttttttttgtagagagtttatgaaggacgtgt

SEQ ID NO: 1046 - DNA, 6323 bp, Artificial Sequence
  chemically treated genomic DNA (Homo sapiens)
gtacgttttttataggttttttgtaagaagaaaaatatggttttttttgttcgatttcgtaggtagttagattttatcgttgtttttttttgttttttaaaagtcgttgttattttatttttttttaaggtgttttgattttatgttgtttaaatatatacgttttattattaatttgtagagttaatataattgttatagcggttttgaggtgacgtatatttttagtttacgaagataataggattaagagattaaagtaaagataggcgtaagaaattataaaagtattatttgggaattgatgaatgttcgtattgaaatgaaatttttataatttacgtgtttcggtcgtagttttagtcgtttttttcgttcggggtttttgatttttcgtaacgtatacgtgtatgtgcgtatatatgttttcgtttatcgtcgataggtttgagattttcgtttattttggatgtgaaaatgaattttgagaggttttattagttagattaatttggttacgggtattgaagcgtggagatgtagtagttcgtggggaaaatttaacggttaggttgattaaagcgtatgtgcggggttggggtttttgatagatttttagtcgaagtttgttttttattgtttgatttacgttttttatcgtttttttaaatgttaaggaatatgtggagatggtatttatttttagcgttaagattcgttgtgggattttttttttttttttttttttagtatagatgagtttagttttataattttttatttaattcgtattgattttattgtttggttgattttttaggttaatggtagaagttagtcgattttttgttaaaatttttttgtaggggtaaagtagacgtttaattaattgtataaatttgtttcgtgttattcgtgggattttggtatagtcggattatttgtagggattagattttatcggggatagagatgtttgttatttttacgggaggttggtttgtttgttagcgtgttgtgggtggatgttagtgggtgatagcgacggaagaaggtgttcgatttcgtggttggcgtttattttagttcggggtaaggggttgatattaaggaaaggagagaagtatgtcgcgtgttgggagttggaagaaggagtttagggtgtttagggggtgtatagggttggttggttaggtttgggagtgaggttgtgtagttaaacggaggttgtgtagatgtttggggcgttagggtatttcgcgggttgtttatgttataggtcggagggattttagttggtggcggagttggcgtgagtttgaagaggttgaaggaggttagggttgggggatatgagtcgtttgagagaggggtattgacggcgagacggagagttggttgtgtgagatagagatagagagatagagatatagagatagagagagagagagagatagagaaagatagagagtgagagagagagagagtgagagtgtgtgtgtgtgtgtgtgtgtgcgcgttagagtgtgtgtgtgagtgaaggggtgggtggcgtgagataaaggtgggggagggagggttgagtttgaaggttggtgggaatagtatatttttagtcggttggtttgggtaggaacgaagtttgtgtggttaaaggggattcgcgtcggcgagattgggatgttgtttgggttgggcggttagagtatggagtggggttggggtgaggtggtaagtagtttagggtgggagagatatcgtgatagagcgattggaggttacgttttacgttttaaaagggtagggaatgtaattggattcgagatataaataagtcgtttttaggacgtatatttacgttttaggtatgtgtttggggttgagatgaaaagaggttcgagggggagaaataaggtagtattttcgattaaagtggtggattggggttaggttgggagttgcgatatggcggtggtggtgtcggtagaatgaggggagagagtgtggagtagtcggaatacggtgaatatagacggtgtatatgttacgcgtatattcgtgtggtcgcgttaaggattgtgtgattaattaggggaaagtgatgagttattttttggagtcgcgattttttttttattggaagggtaattatggtattattttttggatgtggggagttagcgaggggggggggggagagagatagagagagagagagagagagaggtcgaggcggtgaaatgtgaagagaaggggtggtgcgagtggttgtaagttcgtggtgtttggcggtgtttcgtgaagtgaaatgcgtcgggtagaggcggtggtagggtaatgaagagaaataggattaggaggttgttaagttttggtgtttggcgcgttttcgtgtttggaggggttgttgttattaaggtgtgtgggtgcgtggggtaggtttatttttaagttagtcgagagaggtacggaagaaagggtagagggtcgtcgcgcgtgggagcgtagtcggtgtcggattcgttcgcgcgtttcgagtgtaaggaggcggtagaggcgagcgtagttacgttttggtgttgttgtagtattaaaatgggagggcgtgttgtatgggtcgggaatcgaattcgggtttttcgcgtggtaggcgagaattttttttttttttttttttttttttttttttttttttttttttttcgtgtggtgttttttttttttattatcgtggggttagtttttttatttgtgttattagtaggtgagaggcgggatgggtgtgttagcgagcgggggcggcgatggggaacgggtttcgtagtcgtggcgtgcggtttagaaacgtagattaggttcgtgggcgtttcgtttttgcgttttgatttacgttatcggttcgtatttggggttcggttttttgggttggtagggaggttggagcgcgagaaaggagcggaggagcgtttcggtagagtcgtagttggttgattttggagaaggcgcgttgggtgtggttgggacggtttaggtcgcggtttttcgcgtggggatgcgttgtggcgtagagttggtttcggcggggttaggcgtttgtgggcgggtgacggggatttagggttttcgttcgtgattttttttgggttgttttttcgggtttggattcgtttgttcggttgtgtgtagggttttcgttgtttttggtcggtaggcgttcgggttgtaggtgggtcggtaggtaggtgttagcgggaagggagtataggtagcgaggtgggatcggcgatttggttagggtgtcggtagaatggaatgcgcggtcggggttcgaggggtcggaggaaaggataggatgttggatggcgtgtttttggtgggagacgtgtgtgcggttttacgagcgagtcgttcgttgttgtttagcggttagaagttggagggtgaaatcgggcgggttgtttaggttaggacgtttttgggtagcgtagcggcgatttaaggcggtgggcggtgggcggaggtcggtgggaggaaggagggaaaaggaggaataggggaagaatttgggttgtgtttgtttgggcgagtgaggagaaggcgggcggaggagataggtagggaagagcgtggaaggtggtcgcggtcgttcgttgtgtgtggggttagggaagagggcgtgtgaggtggtggggagggcgtttgttcgaagggtaattggtagagggtcgcgggcgttggcgtatggttttgggttgtttttgcgatagtcggcgggtgggtaggaagaacggacgtgtttgagaagcggcggcgttttggaggtttgttttaagggggttggagtttggagagcgggtaagggtttaaggtaggaagcggttaaaggtgttttagggttgttatgggcgttgtttttcggcgggcgggttaaaaggtcggtttgttaggagtgggattcgaatttacgtttttaggggagattgcgatttgaacgtagcgttttagatcgttcggttattttgacggcgcgtcggggcgtttcgtcgttggtatggttgggattcggcgcgaacgtttgcgtttttggtcggcgtttgtttgggttcggtgcgtaatcgacggatcgcgcggggggagcgggcgttaagtgaacggagtcggttggcgttggcgtggacgttttcgcgtttttatttcggatttaaagggttcgcgtcgggtcggtcgtcgtcggcgtacgttttagttttcgcgttttcgttcgtcgaatttcgtagggcgtgcgtttatcgcgttttaggagtagcggtttgattgtttcgttcgcgtttttttttgtttcggcgcgattttcgcgttggagatagtaggtagggcgcgcggggaggttttacgtcgtttcggtatttgtcggggttcggtttcggtttcgggttttagcgggatcgtagggtgttttgttgggtgtcggggtaggtcgtgttaacggtggcggggggcgggtggtaggtgacgggtggcgtgtggcgggtggcgggcggcgggcggcgggtggaaggcgagtacgcgttcggtttttgtcgtcgggggaggggattaaggtagggttaggcgttcgcggtcggagtggggtttggcgtttcggcgatcgtcgtcgtcgttttcgttagtatagtggtgagtattttcgtttgttacgcgggagatcggggttcgatttttcgacggggaggtagtcgtgttttttgggtcgtcgtttcggatttagtttgtgggttttttttttttttttttcgttttttagttagtcgtagggtgttatttcgggtttggtttgtttggttttttggttttttgggtttttttggttttttgtttttttttttcgttcgcggtttggtagcggtagtcgggaggttttttttggttttgtacggcgtttaacgagttgtcggtttaaagtggttgtcggaagaggttttttgcgatatacggggttttgcgttcggtgggaagcgtaggagtggggattttgtcggcgtcggtcgtttttttttcgggtatttgttggggaagggttttgggggttcgaggcggcgagtgagcgagagcgtttttagaggtaggcgggcgtaacgggttagtcgcgttggttttgtatcggtggggcgcggggcggtttttggagaggtcgcggtagcgcggagttgcgggcgggcggacggatcgggcgtcggggtcggtttgtttcgggcgtcggcggcgcgttggtgggagtttcgggtcggcgcggcggggttgttcgcgtcgtgcggcgttggtggtatagtggtgagtatagttgttttttaagtagttgattcgggttcgattttcgtttaacgtatcgggcggattttttgcggagatttcgcgcgcggagttcgcgtcgtagtttggtttgtggttgcgtgtttgtgcgtcggggaaggaggtttgcggtgtttggagggtgtgttatttatttttatttatttgtttttttggtttggttgacgttattttcgtaatatcggttttgtagtttttttttgttatgtgtttatttcgttgttattgttttttagcggttaagtttattggttaggttaggtttttttttcggattgtcgttaggtgatttattattattattagtagtattttcgtatttttttttggttacggaatgttttagtagtgtggagtagagcggttttcgttagtttaagtcgggtggttgaggggttatttttttttcggttgagggggatttacgtttaatgattgggttattcgttagagttatttatgttagtaagtttattggtttttttaaggtatgttagattttgagcgcgggatttttgattgggttttacgggtgttagcggttttggtagaaatggtagtagaatttgaggagtcgagattacgggttatggcgttggggagggagagttgtgataattatttttgtagtatgattatgtttttttttatgtagatatgatattggtgggatttttgtgatatgtggtgatgtttgtatattgcgtaatgatttatgattaattgaggggttgtatagtatttgtgggtatttatttagtgggtatttgttatttttatttgttggaaataatttatgtgttgttttttagttttttggaaatatattttaatatatcgttgttatttttagtcgttttagtttgttatagaattttagaacgtattttttttatttatttatatgtttatatttatttcgttaatttttttttattttagttatttatata

SEQ ID NO: 1047 - DNA, 6518 bp, Artificial Sequence
  chemically treated genomic DNA (Homo sapiens)
tataaaatggagagaattttaatgtttattttataggattatattaggaggtttaaatgagatatgatttttaagttatttagaagagtatttgatagtgttatgtaattgttagttagtattttaagtttttgagggaaggggaagtcggaaggagaagatgtttgggattatggaggttatgattttaataattggtatagattagaattttgttataattattagaggtttttagtgttaagttttaggggaagaaattttgatttgattattatgatatttttaatagttgtgggaatagtttgtgtagatggagtatggttatagtaaataggtgttgaatgaatttataaattgttgtgttagttatttttcgaaggagttttagaattgaacggttagaagaatttgtgaggaagtaaagggagatttatttttttatttacgtttggttttaaagagaaatgaggtggtaggtagagggtaaggattcgttagaggaaatagttttagagtttagggatgaggagggggtgtttaggattgtgtggattgttatattatttttaggtggatttttttagttgtatttagttgggaatttttgggtttttgggatttagtttagaaaattgttttttttgggatttattttgtttatttttttgatggttagatagtggattaaagggagtaggaattgtttttgggtcgtttttatattttagtgtttaatattatagttggggtttaatttagttttgtggaataagtgtttttaaagatttttatgttttttatttttttgaatttaatttaaatgtttttttttttttgaagtttttttagttattttagttagtgtatttggtatttatgtttattgttttgtgatttatattagttgtggatgaataatattattgtatttttagtattttatataatgttaggtatatagtaggtgtttaattaatgtaaatgaataatttaatgtttttttagtaatagtaattaatttatttagttattttttttgttggtattttaagagatatagaagaagttaagattattatttatgtattaattagatattattgaggggtttttttttttagttttatttcggtgtatttgttagagtatttatagattttttatttatattggtttgtttttttattggttttttattttatttttgaggtatgagaagattaatagttcggtaaagttacggggtttttagattagttggagggggttgtgtcgatgtgtgtatatatagagggtttagggtttttgggggtttttttgttttttaatttcgtgtagaatattttatttagtgggaaagtgagttaagttttcggtgttaattaggaagtgatgaggatgcggcgattttattgatttatttagtatcgatttttaacgtatggtttttagtttgagttgatattttatttatttcggtttttttagtatttaagtttattttttcgttaggtgattttttcggagtatcgattggggtcgtaggcgttttgtttcgtcgttttcggagtttgtttttggggagtgggggtggtcgtaattattagtcgcgaggagaggattgtatttttttttttcggtcggtattcgaatagagttagtttttatttttgtagtggcgaagtgtttataaagttcgcgtcgcgtcgtcgatttagagttgggtaggaagtggggaagagggggcggaggagataaaggggttggtgttttgtttagttaagtttcggttttcggtttgatttttttattttttgtatattttcggcgaggttaggaggtttattcggcgtcgcgtattttcgttcgtagttttcgttttacgcggtataggtgcgggggcggggcgttacggaggtttaggtgtgggcggcggggtcggggtagtacgggttttcggatcgttgtttttcggcgttggtaatttttttacgtgttatttaggaagtaaataatattatgaggagcgattttttttttttttttttttttttgagatggagtttttttttgtcgtttaggttggagtgtagtggcgcgatttcggtttattgtaattttcgtttttcggatttaagttatttttttgttttagtttttcgagtagttaggattataggcgtacgtcgttacgttcggttaattttgtgtatttttagtagatacggggttttattatgttggttaggttggtttcgaatttttgatttgaggtgatttattcgtttcggttttttaaagtgttgggattataggcgagagttatcgcgttcggtcgattttttgatttttattatacgttaggtattgtgatagattttttttgtgtattattttattttttttttagttttatagaagaggaaattgagatatattgaggattaaggttaagtgttcgaagtattatagttggttagtgttaggatttaagtttagaatttgcgttttgttaggtatttgtaaatggggacgaatacggcgtagttagaggggttgataggttagggagaaaattattggtagtcgcgggtattttacgttttgggagtgaggcggtaagggataagtttttcgttttttagatttgtttcgtaaatatttgcgggtcgagggcgcgaaggtagtaggatgtagcgatagatttggattaggtggtttaggttttatttttaagtgggttattgataggcggggcggtttttagtataaaattattaggttggatgttttagggttttttaatattattcgtttagaagaattatttggggagttttttaatgagaaagatttttaagttttttttttagagagtgaagttattgggattgggttgggtttagttaggtgttattaataataagataagtttggaaaattttgcgagtgtagatgattttttggtatgttttttataagaatcgatttttatattaaaataggttttttttaatttagtgaaatcgggcgcgtttttttggtttataattaagttattgaaggttttagaatattttatttttaaaaggttacgtgaggttggcgcggtagtttacgtttgtaattttagtattttgtgaggtcgaggtcgcggattgtttgagtttaggtgttcgagattagtttggttaatatggcgaaattcggtttttattaaaaatataaaaattagcggggcgtggtggtgttcgtttgtaattttagttatttcggaggttgaggcgggaggatcgtttgagtttgggaggtggaggttgtagtgaatcgagatcgcgttattgtattttagtttgtgaaacggagtaagattttgtatttaaaaaaaaaaaaaaaaagttacgtgagtcggggttatcggaggcgttttttaatcgattgggtttcggaaaattaaggggcgtacgtcgtttcgtttcgtttcgtttcgcgattataagttttatcgcgtttcgcgttcgcgtatattacgttagaataagatggtcgacgcggcggttatagttggggtcggtggtttcggaacggtaagggtaggaagcgcgggttcggagtcgagagagtttgggtattttgtaatttttttttcgattgagtaataagataatgtttagaaatttagttttattatgagtttcgattggcggagggtgtttttaggtcgtaggcgttttttttttgggatttggttgcggttttcggagttggcggatttgtgttttgattggttcgttcgttgttgggggttgggagttcggaatattttcgattggtttgaagatgtcgttttcgtttttttattggtcggttaaagttgaaaggtattttcgttttaaaatatttagtttttttatttttttgtgtttttattttttgttttttttttttcgcggttattttttgttattgtttttatttttttttttaatgaaatggtgtgaagatgggaggtataagagagggattttgttttttttgcgggatacgttttaattttattatgcgtgtttttttagttatgtattttaataatttgttaaagtagaaagtaaaagatttgttattttattttattgggattgtacgttttaggtaagcggagaagtggtttttgtatttaaagtattttgggtgtttaatttttatttagttggttaagatttgtaaatttaaatattaagtattgatttttaaaataaaattatttagtaaaataattttgtttgtcgttgattacgtatgaattatgtgattgtattttttttttgtggatgaaaatttttttgttgatttatagagatcgggaagtaaatagtttattaattttgtcgataattattatttggttcggaggagaattttgtaggtggttgtgagttttttgttgatagaggtagggtttgagagtgtcgagaaagtattcgtggaaacgttgatagagatgttgtagagttgtgagtatatggaaatatttggttttggagttaattttaatattagttttgtgttttgttttgtgatagtgtttgagaggatttaagaaataaattttttttttaagaggggagaaaaaaaattttttttaatgtaaaaagttgagaaaagaaaatagtataatgggtcgagcgtggtggtttacgtttgtaattttagtattttaggaggttgaggcgggtggattatttgaagttaggagtttaagattagtttggttaacgtggcgaaatttcgtttttattaaaaaatatataaaaaaattagttgggcgtggtggtaggtgtttataattttagttattcgggagattgaggtaggagaatcgtttgaatttgggaggtagaggttatagtgaattgagatcgtattattgtattttagtttgtgaggttttatttttaataataataataaaaatagaaaagagtataatgaagtgatttataggttttagaattagatagatttggtgtatattattattttgttatttaatagtttgggtaagttattgaattttttgaattttaatttttttatttttgaaatgggataatagtttttattttatggatttgtgagtgtaagtgagatgtatatataaaatatttagtgttggggagattttaagtttttggtgagttatgggtgtttttaaggatttttgttggggagttaggattaattttttatgtaatagatattattatattatgtaatgaaatgttagattgtgtgatataaagaatgaaggggaaaagttttttttttttttttttttttgagatagagttttattgtgttgtttaggttggggtgtagtggtataattttagtttattgtagttttcgttttttaggtttaagtaatttttttgttatagttttttaagtagttgggattataggcgtgtattattacgtttggttaatttttgtatttttagtagagatagggttttattatgttggttaggttggttttgaatttttgattttaggtgatttatttattttggttttttaaagtgttgggattataggtatgagttattatatttagttgaaaagttatttttaaaaggaaatgtgttgagatttagaagttcgggtgtggttttatagaggtttttttgtatgtataatatatttttttgttttgaatttttggggtatgggatgggatgagggatggaagtatttacggtgttttttagggattaataattatgaaaggaagtaggagaaaggtttgggtagagggagatgtggggtgtaatgtaggtttaataaagaagtggataatttagttaggatttttggagtattattgtttattaagttgaaaaggttttgtttttatatttaggttttgattaaatagtagatgtgggttattttaggaagggtgattttgggtaaggtggttttttgtagttgatatttggtatttttaaatattaaatgtttttttaaagtagtgattttaattattgtggttttagaatttttatatttatttatttttattaattagagatggggttttgttgtgttgtttaggttggttttaaatttttggatttaagttttttatatagttgggattataggtatgtgttattatatttagtttttagaatttttttatattaataaatattgaggattttaagtagtttttgtatatgtgtatttgttacgttagaaaaaataaattttgggtttaggtgtggtggtttacgtttgtaattttagtattttgggaggtcgaggcgggtatatcgtttgaggttaggagttttaagattaattttgttaatatattgaaattttgtttttattaaaaatgtaaaaaattagttggatgtggtggcgggcgtttgtaattatagttattcgggaggttgaggtaggagaatcgtttgaatttaggtggtagagattgtattgagtta

SEQ ID NO: 1048 - DNA, 6518 bp, Artificial Sequence
  chemically treated genomic DNA (Homo sapiens)
tggtttaatgtaatttttgttatttgggtttaagcgatttttttgttttagtttttcgagtagttgtaattataggcgttcgttattatatttagttaattttttgtatttttagtagagatagggttttagtatgttggtaaggttggttttgaaatttttgattttaggcgatatattcgtttcggttttttaaagtgttgggattataggcgtgagttattatatttagatttaaaatttgttttttttaacgtggtaaatatatatatataaaagttatttggggtttttaatgtttattaatataaagggattttgagagttgggtgtggtggtatatgtttgtagttttagttatgtgggaggtttgggtttagaagtttgaggttagtttgggtaatatagtaagattttatttttaattaataagaataaataaatataggagttttgaagttataatgattgagattattgttttaggaaaatatttggtatttaaaagtgttaaatattagttgtagagagttattttgtttaagattattttttttggggtagtttatatttattgtttgattaagatttgagtataaaggtagggtttttttagtttgatgggtaataatgttttaggggttttggttaagttgtttatttttttattgggtttgtattgtattttatatttttttttgtttaaattttttttttatttttttttatagttgttgatttttaagaaatatcgtaaatatttttattttttattttattttatgttttaaaagtttaaaatagggaaatatgttgtatatgtagaaaagtttttgtaagattatattcgggtttttaaattttaatatatttttttttaaaagtagttttttagttgggtgtagtggtttatgtttgtaattttagtattttgagaggttaaggtgggtggattatttgaggttaggagtttaagattagtttggttaatatggtgaaattttgtttttattaaaaatataaaaattagttaggcgtggtggtgtacgtttatgattttagttatttgggaggttgtggtaggagaattgtttgaatttgggaggcggaggttgtagtgagttgagattgtgttattgtattttagtttgggtaatatagtgagattttgttttaaaaaaaaaaagggggggggggttttttttttttattttttgtattatataatttagtattttattatataatgtgatgatatttattgtatggggaattagttttgattttttaataaaagtttttaagggtatttataatttattaagagtttaaaatttttttagtattgaatgttttatatatatattttatttatatttataaatttatgaggtagaaattgttattttattttagaaatgaggaaattgaggtttaggagatttagtggtttgtttaagttattaagtgatagagtgatgatgtatattaagtttatttgattttaaagtttgtaagttattttattatgtttttttttgtttttgttgttgttgttggagatggagttttataggttggagtgtagtggtgcgattttagtttattgtaatttttgttttttagatttaagcgatttttttgttttagtttttcgagtggttgggattatagatatttgttattacgtttagttaatttttttgtgtgttttttagtagagacggggtttcgttacgttggttaggttggttttgaatttttgattttaggtgatttattcgttttagttttttaaagtattgggattataggcgtgagttattacgttcggtttattgtgttgttttttttttttaattttttatattaaaaaaaattttttttttttttttttaagaaaaaagtttgttttttaaatttttttaaatattattataaagtagggtatagaattgatgttggggttgattttaaggttaagtgtttttatgtatttatagttttgtagtatttttgttagcgtttttacggatgttttttcggtatttttaaattttgtttttgttagtaaggagtttataattatttgtagggttttttttcgggttagatgatagttatcggtagggttagtggattgtttatttttcgatttttgtgaattagtagagagatttttatttataggagaaggatgtaattatatagtttatacgtggttaacggtaagtaaagttattttattaaataattttattttaaaaattagtgtttaatgtttagatttatagattttggttaattgagtaaaaattgagtatttaaggtgttttaaatatagagattattttttcgtttatttaaaacgtatagttttaatgagataaaatagtaggttttttattttttattttagtagattattagaatatatagttgaagaaatacgtatgatgggattaagacgtgtttcgtagaaaaaataggattttttttttgtgttttttatttttatattattttattgaaagggaaaatgaaaatagtaataagaggtgatcgcgaggagaggagggtaaaagataaaagtataaaaaagtaagaaagttaaatattttgaaacgggaatgttttttaattttggtcggttaataagaaggcgaaaacggtatttttagattaatcgggggtgtttcgggtttttaatttttaatagcgaacgagttaattaagatataggttcgttaatttcggaggtcgtagttaagttttaaggagggggcgtttacggtttgaaaatatttttcgttagtcggagtttatgatggggttgaatttttgggtattattttgttgtttagtcgaggggaaagttgtaggatatttaaattttttcggtttcgagttcgcgttttttgtttttatcgtttcggagttatcggttttagttgtggtcgtcgcgtcggttattttgttttggcgtagtgtgcgcgagcgcggggcgcgatgggatttgtagtcgcggggcggggcggggcggggcggcgtgcgttttttggtttttcgaagtttagtcggttgggggacgttttcggtgatttcggtttacgtgattttttttttttttttttggatatagagttttgtttcgttttataggttagagtgtaatggcgcgatttcggtttattgtaatttttattttttaggtttaagcgattttttcgttttagttttcggagtagttgggattataggcgggtattattacgtttcgttagtttttgtatttttagtagagatcgagtttcgttatgttggttaggttggtttcgaatatttaagtttaagtagttcgcggtttcggttttataaggtgttgggattataggcgtgagttatcgcgttagttttacgtgattttttgagagtgaagtgttttggggtttttagtggtttggttgtgggttaggaaaacgcgttcggttttattgagttaaaagaaatttattttaatatgaaaatcggtttttataaagagtatattaggagattatttatattcgtagggttttttaaatttgttttattattagtaatatttggttgggtttagtttaattttagtgattttattttttggaagaggggtttgggaattttttttattaaggagttttttagatgatttttttgagcgagtaatgttgggaaattttggagtatttagtttggtgattttgtgttgagggtcgtttcgtttgttaatggtttatttggaagtagagtttggattatttagtttaagtttatcgttgtattttgttgttttcgcgttttcgattcgtaagtatttgcgaggtaagtttagggggcgggagatttgttttttgtcgttttatttttagggcgtggggtgttcgcggttattagtggttttttttttagtttgttagtttttttagttgcgtcgtgttcgtttttatttgtaggtgtttggtaggacgtagattttgggtttggattttaatattagttagttatggtatttcgggtatttgattttaatttttagtgtgttttagtttttttttttgtaaagttgggggaaagatgagatgatatatagaaagagtttgttatagtgtttgacgtgtagtaagagttaagaaatcggtcgggcgcggtggttttcgtttgtaattttagtattttgagaggtcgaggcgggtggattattttaggttaggagttcgagattagtttgattaatatggtgaaatttcgtgtttattaaaaatatataaaattagtcgggcgtggcggcgtgcgtttgtagttttagttattcgggaggttgaggtaggagaatagtttgaattcgggaggcggaggttgtagtgagtcgagatcgcgttattgtattttagtttgggcgatagagggagattttattttaaaaaaaagaaaaagaaaaagaagtcgttttttatgatgttgtttattttttggatagtacgtggaggagttgttaacgtcgggaggtagcggttcgggaattcgtgttgtttcggtttcgtcgtttatatttgagttttcgtggcgtttcgttttcgtatttatgtcgcgtggggcgggggttgcgggcgggggtgcgcggcgtcggatgagttttttggtttcgtcgagggtgtatagggggtgggagagttaggtcggggatcgaaatttggttgagtagagtattagtttttttgtttttttcgtttttttttttttattttttgtttagttttggatcggcggcgcggcgcggattttgtaaatatttcgttattgtaggggtggagattggttttgttcggatgtcggtcgggggggagaggtgtaatttttttttcgcggttggtggttgcgattatttttattttttaaaggtaggtttcggaggcggcgggatagagcgtttgcgattttagtcggtgtttcggggaggttatttgacgaggaggtaggtttgggtgttggagaaatcggggtagatgggatgttagtttaggttggagattatgcgttggggatcggtgttgggtgggttaatggggtcgtcgtatttttattattttttagttggtatcgaaagtttggtttatttttttattgagtgaggtgttttgtacggaattgaagggtagagaaatttttaaaggttttgagttttttgtatgtatatatatcggtataattttttttagttgatttggaagtttcgtggttttatcgggttgttggtttttttatgttttaaagatggggtggaaggttagtaggagggtagattagtgtggatggggagtttgtgagtgttttggtaagtgtatcgggatgaaattggagggagggattttttagtggtgtttgattgatatatagatgatgattttagttttttttgtgttttttgaagtgttaataagaggaataattgaataaattggttgttgttattaagggagtattaagttatttatttgtattgattgaatatttattatgtgtttggtattatatggaatgttgagggtgtaatgatgttatttatttatagttaatatggattataaaataatagatatagatgttaagtatattggttggggtggttgggaaggttttagagagaaaaggatatttgagttgggtttagaaggatgaaaagtatagaagtttttgggggtatttattttatagaattggattgaattttagttgtggtgttggatattggaatataggggcgatttagaaataatttttgttttttttaatttattgtttaattattaagggaatgaataggatgaattttagaaaaggtagttttttgggttgggttttaagaatttaggaatttttagttgggtatagttgggagggtttatttgggggtgatgtgatagtttatataattttgggtattttttttttatttttggattttgagattgttttttttgacgagtttttgttttttgtttattattttatttttttttgggattagacgtggatagagaagtggatttttttttgtttttttatagatttttttggtcgtttaattttggggttttttcgggaaatgattgatatagtaatttatgaatttatttagtatttatttgttatggttatattttatttgtataggttatttttatagttgttggggatgttatggtaattaaattagagtttttttttttggaatttaatattgaaagtttttgataattgtagtagagttttagtttatgttagttattgagattatgatttttatggttttaaatatttttttttttcggttttttttttttttaagggtttagaatattagttaatagttatataatattgttaggtatttttttaagtggtttagagattatattttatttaaattttttaatatagttttatgaggtaggtattaggattttttttattttata

SEQ ID NO: 1049 - DNA, 6238 bp, Artificial Sequence
  chemically treated genomic DNA (Homo sapiens)
attttagtaagattttgttttataaaaaaaaaaaaaaaaaaaaaaaaaagtagtagaggtagtagttatttattagataagatttattgtttggattgtttttaagttataattttggattttaaaattttaatatttattattgtttgttatttttttttttagggaggtaatgaaggtggggagagaattaagatttacgggtcgggcgtagtggtttacgtttgtaattttagtagtttaggaggttgaggtgggtggattacgaggttaggagattgagattattttggttaatacggtgaaattttatttttattaaaaatataaaaaattagtcgggcgtggtggcgggtatttgtaattttaattatttgggaggttgaagtaggagaatggtgtgaatttaggaggcggagtttgcggtgagtcgagatcgtattattgtattttagtttgggcgatagagcgagattttgttttaaaaaaaaaaaaaagatttaggaaatagtagatgaagtataggtagaatttatttaggaaggtatggaatggggtttgggatatgagttataaaggggaaattagatttttttagtgtgttaatttttttaaggaagttagaggatattggggtttgggaggtgttttttaagttaagattttttagaataaaggttttatttttattatagagagcggttcggaaagggtagaggtgatttggtaaatttggagagaggggttttgtttttgtggtttttggtttagtgttagggttttggggtttagaggttgtaagaagtggagttagtgagttttaggtatgtaagataatattttaagtgtttatttttttttgagtattttttgaatattatagttattaaagataagttttaattttttagaggttattaggttttgaggattaagtttagttttgtttttggaagtaggggggagagaggagtttgttggagaattttgggtaataagggttttggttggtagtgtcggagtgtgttgatgaagtaatagttgaatattatatagtttatagttagttggagaattaaattaatatataaaggtgatggtgaaaaggatatagaaatgaggaggtgtattgagagaaggaaagatgaagtaggagattttttagagttttggggagattttaaaggttttagggatttttaaagattttattttttttattattcgttaattttgttatgttttttttgagttatattttttaagaggtatttatttttggatgggtttatttttaagagtagggattgtaggattttaagggaaggtttggaattatagtggttttattatttatttaggtatttgtagttggtattatgttaaaaaagttttgtagaaagaggttttattttttttttttttttttttttttggaaataaaagtaggttgtgttttttttgttcgtttttagagattagggaaacgggagttggaagggtattttggattatttcgttaaatttttatttagtatattaatgtttgtgttttttgttttggttattgtcgttttagtaaaggaggttaaaattagttattgcggttagggcggttgcgaagtggtttaaagattaacgattggggtcgtgtagggtgggtacgtagtttttggggtttaggggaaggggaatggtggtcggcgttcgggtttttttttttattggtaggagtgggggtgtacggaaggagggtattaggagagttataggtttttattggttatatgggaatagggtttggagaaggttttgtatagttatagtcggagtttcgtgttagggttagatcgttttcgttatgggatcggtttgtttatcgagaaattttatcgagaattgtaaatgggtatagaagattgcggagggggtagggataggggttttggagaggtaagaggggaatcggtattttttatttggtgcgcgtaaattaagattttattttgtgtcgggtttttttttttcggtttaatttttttatttgtttttatttttgtttttaaggttcgtgattcgcggaggtgatgggggggataggagagttttagggatcgtagaggtgatataatcgttcgttcgttttttttcgttgggagtcgatttagtttgtgtcgagttttttttttcgcgcgtttttgcgtatagcggtggtatcgtaggatttcgggtttttttcggttttttatcgggaagtcggtaaatgcgtttttttaggtagatcgcggcggggtgggggcggggggggggcggaagttgaaatattgggatagaaatatttgttcgttttaagggacggaaaattggatgttaagggggtcgcggcgcgtagcgggaggcgaggggagatcgggggtcgttgcgtatcgttcgtagtcgaggggcgagcggcgatttcgcgcgttttagcgcggtttggttacggaggtcggggcgtagggggcgtcggcgggatttattttagagtagagtgagtggtttggttttggggatgagtattagggagtatacggtttttaagtggagtaagtttattaggacgatatttttttagacgatgttttgtcgttgttcgcgcgcgtttggttttttcgggtcgtcgtcgtttttagagttttcgagttcggtacggattttttttttggcgtcgtagaaagggatttttttcgcgtcggtggtcgggtttggtatggttgggcgaggtgggcgttcgtagtagcggtaggtaggtaggcgttttgttcgagcggagttcgagggtgggggcgggggtttttgttttttaggggggaatttttcgtacgtttagttttttttttttagtttttttttcgggtttttgcgtttttttttagggttttagcgtggtttagggatgtagattttggcggtcggcgtttgttgttggcgtattttttatatggttgttcgggttgaattcggtcgcgagaaagaggaggcgcgcgcggggcgggaggggcgcgcggtcggggaggaggagttgtgaaaatggaacggggtcggcgacgttggagggagcgtttcgaaggagcgcggaagaaagttttgtttagttatagttaattaggagcgttcgtgcggcgtttatagataaaggcgtttttttttcggtttttcggggtcgaattggggagttcgttgggcgggagttggtcgttttcgttcgggggcgggtggaaggtggttttcggggtagggagtttgtagggcggtttatagcgtttttgtttttgtgtgtgtgtgatttttaaaatgttttttatggtatttttttagttttttttttaaaaaaaaatttttcgaaattgttatttttttgagaagttttttatttttttttaagttttaggttatttgggttggagaattttaaatatttgtttggagtcgcgattttagttaaggttagatttacgatgagaattagaagttttttaatttgttagttagtagggtttttcgggttaggggagggttggaaggtagttgttcgtttttaattaggtagttgtggattatttaggtatatagtaagtgtttagttggtgtttgtgaggtgatgtatagatgatttgggttagttcgttgtttattttttgtttattcgtcgcgttattttgtttatggttaattttagttaattagcgtatttttgtaacgtttttttagtttttagtgaggaatattattttgaaattaatattattgagaatcgggttttataaaaaaattatttagaatgttttaaggaaaattaatttgtgaaagatttgtgtttgtttattttttttttagagttgatggtttaagagttttttagagaggattttagttgtatagaaaatggagggaggattgagttggaagtgtttgaagtaggtgtgatcgtaattgcgggtaggtagtagaagtaaaagggttcgggatagtatttttgagttttagttttaattggttggaatttagtttaattttttgggtacggatttttttatttgagaagtagaattagtttttatttttttttttagtttttatattttatgaatgtgagttcgaaggggcgttattatattgattaaaattagttgatttttagattaatcgttgttaggaattatttttaggattttaagagaggtaaaaaaatttaaaagattgattgtatgaaagggttatgtataagtattttattgttagtagatttgagttagttttagtagttagataaaataatgtttgatttaagttaaagtaaggtatgtggtatttgtggaatttaggttattgagttagtgttattgtgttgttttagacggagttgaaattatagaatttgtttggagattagataaatgtcggttttatataatgattagttagatagtggaatatgaagttggagggtgcgatttttatttgtttgtttaatttgggttatgtaatgaattacgttttttttttatgttttttttgttttttatatttagtagatttttttattttttgtggttttttagtttagattgttttttttttttggggtagattagttgttcggttaaaagttttttttcgggttattggaaaggtttaatgttgtaaagatttttattttaaatatttagttatttatttggtatttattgggtatttgttatgtgttaggattagtgggtataggggatttaaggatgaataaagtttggtttcgtttttaaaggagtttttatttagaagtaaagatggagtaaataaatgtaattttttgattatgattttggaagggtagaaagttatagtttattatcggaaaaaaaaatttaattaggtattaaatttatatataaggagtttaagggaagtaaaaatagttttttattgttttttttgagaattttattaggttagttgttttattttgaatttattttttgtttgtttgtttgtttttgtttttgagacggagtttcgttttgttgtttaggttggtgtgtagaggtttgatttcggtttattgtaagatttgtttttcgggtttacgttatttttttgttttagtttttcgagtagttgggattataggtgttcgttattacgttcggttatttttttttttttttttttttttgtatttttagtagagacgggggttttattgcgttagttaggatggtttcgattttttgattttgtgattcgttagttttggttttttaaagtggtgggattgtaggcgtgagttattgtgttcggtttttgaatttattttgaatgaatatttttttttttttttttttgtgggttagattaggtatgattagttattttagttggttgtttttataatggagaagatgtttttgtgtgttgagggaggaaagaagtgttatttaggtttgttagagtttgtttataaaaggattgttgaagaaaaatggtttttttaggtttagttttagagtgaaatatttataagatttaagatatatttttgttgataacgacggttttttttagttaattatgttataggggttattgttttttttttttgttttgttaaagattttagtatatttttttagtttttagttaggattttaggagtggataagtatttatttgttttaggatggggtaaatgggatagtaatttttattttgttaaatacgtaattattaaaaatgtaataagagttataatggtggtatacgtaagataatgtagaggtgtaaaggagggagttgttaatttatatagaagtagggaggagggggagtgatatttggggaaggatttttaaaaaatatttaattgtggtaaaatatatgtaatataaaatgtatgtaataaaatttattattgtaatcgtttttaaatgtatagtttagtagtgttaattatatatgtatattattgtgtaatcgatttgtagaattttattattttgtaaaattgaaattttatgtttattaaattttttttttaatttttatttagatgttggtaattattgtgttattttgttttaattagtttgattattttagatatattatataagtgaaataatagaggatttgtttttttgtgattggtttattttatttagaatgtttttaaagtttatttaggttgtatgtgttagaattt

SEQ ID NO: 1050 - DNA, 6238 bp, Artificial Sequence
  chemically treated genomic DNA (Homo sapiens)
gaattttaatatatataatttggatgagttttgaaaatattttaagtgaaataagttagttatagaaagataaattttttattattttatttatatgatgtatttagagtagttaaattaattgaaataaagtagtatagtggttgttagtatttggatggagattgaaaggggagtttaatgagtataaagttttagttttgtaaaatgataaagttttgtagatcggttgtatagtaatgtgtatatatagttaatattattgaattgtatatttaaaaacggttatagtggtaaattttgttatatatattttatgttatatgtattttattataattaaatattttttaaaaatttttttttaggtattatttttttttttttttgtttttgtgtgaattaataatttttttttttgtatttttatattattttgcgtatattattattatggtttttattatatttttggtaattacgtgtttgataggataagggttattgttttatttgttttattttgggataggtgaatatttatttatttttggggttttgattagaagttaggaaaatatattagggtttttggtaagatagagaaaagaggtagtgatttttatggtataattggttaaagaggatcgtcgttattagtaagaatatattttggattttgtagatgttttattttgaggttggatttggaaggattatttttttttaataatttttttataggtaggttttgataaatttaagtaatatttttttttttttttaatatataaaaatattttttttattatgaggatagttagttgaaatgattggttatatttggtttgatttataggagggaaaagagaaagatgtttatttaagatggatttaagggtcgggtatagtggtttacgtttgtaattttattattttgggaggttaaggttggcggattataaggttaggagatcgagattattttggttaacgtagtgaaattttcgtttttattaaaaatataaaaaaaaaaaaaaaaaaaaaaatagtcgggcgtggtggcgggtatttgtagttttagttattcgggaggttgaggtaggagaatggcgtgaattcgggaggtagattttgtagtgagtcgagattaggtttttgtatattagtttgggtaatagagcgagatttcgttttaaaaataaaaataaataaataaataaaagatggatttaagatagaatagttgatttaataaggtttttaggggggataataaggaattatttttgttttttttagattttttgtatgtaagtttgatatttaattaaattttttttttcgataatggattgtaattttttgtttttttaaggttatagttaagaggttatatttgtttgttttatttttgtttttagatgggagtttttttaggggcgggattagattttatttatttttggattttttgtgtttattggttttggtatatagtagatgtttaataaatgttaaataaatgattgaatgtttagaatgagggtttttatagtattgagtttttttaataattcggagagaggtttttggtcgagtaattagtttattttagagagaaaggatagtttgaattagagagttatagggagtaggaaggtttgttgggtatggggagtagagggagtatgagaagaaaacgtggtttattatatagtttaggttgaatagatagatgaaaatcgtattttttagttttatgttttattgtttgattggttattatatagggtcgatatttatttggtttttaggtaaattttataattttagtttcgtttgaagtaatatagtaatattgatttagtggtttagattttataagtgttatatattttgttttagtttaaattaggtattgttttgtttggttgttaggattggtttaggtttgttaataataagatgtttatgtatggtttttttatgtagttagttttttaaatttttttgttttttttgaaattttggaaatgatttttaataacggttaatttaaaaattagttggttttggttaatataatggcgttttttcgaatttatatttatggaatatggaagttggaaggaagagtagaaattagttttgttttttaggtaaggaaattcgtgtttagagagttgggttgggttttagttagttaaaattagaatttagagatgttgtttcgagtttttttatttttgttgtttgttcgtaattgcggttatatttgttttagatatttttagtttaattttttttttattttttgtgtaattagggttttttttggagagtttttaagttattagttttaggagagaagtgggtagatataaattttttataggttaattttttttggaatattttgggtgatttttttgtaaagttcgatttttaatggtgttgattttagggtagtgttttttattgagagttaaggaggcgttgtagaagtgcgttgattagttagaattgattataaatagagtggcgcggcggatgggtaaagggtgggtagcgaattggtttaaattatttgtgtattattttataagtattaattgagtatttattgtgtgtttgggtaatttatagttgtttaattaagaacgagtagttgttttttaatttttttttggttcgaggagttttattaattggtagattgagggatttttgatttttatcgtgggtttggttttaattagggtcgcgattttaagtaagtatttaaaattttttaatttaggtggtttgaggtttgagaagaaataaaaggttttttaaagggatgatagtttcgggaagtttttttttgggggggggattggaaaaatattataaaaggtattttgggggttatatatatataagagtagaagcgttgtgagtcgttttgtaggttttttgtttcgggagttattttttattcgttttcgggcggaggcggttaattttcgtttagcgggttttttagttcggtttcgaaaagtcgaaaggggggcgtttttgtttataagcgtcgtacgggcgtttttgattggttgtagttaagtagggttttttttcgcgttttttcggagcgttttttttagcgtcgtcggtttcgttttatttttatagtttttttttttcggtcgcgcgtttttttcgtttcgcgcgcgttttttttttttcgcggtcgagtttagttcgggtagttatatgggggatacgttagtaatagacgtcggtcgttaagatttgtatttttaggttacgttaagattttggggaagagcgtaggagttcgggagaagggttggaaggaggggattggacgtgcggagaatttttttttaaaaggtagaagttttcgtttttattttcgagtttcgttcgggtagagcgtttgtttgtttgtcgttgttgcgggcgtttatttcgtttagttatgttaggttcggttatcgacgcggggaagatttttttttgcgacgttaaggaagaaattcgtgtcgggttcgaaagttttgagggcggcggcggttcggagaggttaggcgcgcgcgggtagcggtagaatatcgtttggaggaatgtcgttttgatgagtttgttttatttgggggtcgtgtattttttggtgtttatttttaaagttaagttatttattttgttttggggtaagtttcgtcggcgttttttgcgtttcggttttcgtggttaggtcgcgttggggcgcgcgaggtcgtcgttcgtttttcggttgcgggcggtgcgtagcgattttcggttttttttcgtttttcgttgcgcgtcgcggtttttttggtatttagtttttcgttttttgggacgggtaggtgtttttgttttagtattttaattttcgtttttttttcgtttttatttcgtcgcggtttgtttgaggaagcgtatttgtcggtttttcgatggagagtcgggggggattcggagttttgcggtgttatcgttgtgcgtagaggcgcgcgaagggagaggttcggtataggttgaatcggtttttagcgagggaggacgggcgggcgattgtgttatttttgcggtttttggggtttttttattttttttattattttcgcgggttacggattttggggatagagatgaggataagtaagggagttggatcggggaggagagattcggtataggatagagttttggtttacgcgtattagatggaagatatcggttttttttttgtttttttaaggtttttgtttttgtttttttcgtaattttttatgtttatttgtagttttcggtgaagtttttcggtgagtaaatcgattttatggcgagagcggtttgattttagtacgaagtttcgattgtggttgtgtagagttttttttaaattttgtttttatgtggttagtgggaatttgtggtttttttggtatttttttttcgtgtatttttatttttgttagtagggaagggagttcgggcgtcgattattatttttttttttttgggttttagggattgcgtgtttattttatacgattttagtcgttgatttttgaattatttcgtagtcgttttggtcgtaataattggttttggttttttttattgaagcggtagtagttaggataaaaggtataggtattgatatgttgagtgagaatttgacgaggtaatttaagatgtttttttagttttcgtttttttgatttttaggggcgggtaggagaaatataatttatttttatttttagaggggaagaggaaggaagaaaataagatttttttttatagggtttttttggtatggtgttagttgtaaatgtttaggtagataatggggttattatggttttaagtttttttttgaaattttgtagtttttgtttttggaagtaaatttatttagaagtgggtattttttagggggtgtggtttagggagggtatagtagagttgacggatggtgagagaggtaggatttttggggatttttaaagtttttaaagtttttttaaagttttgggaaattttttgttttattttttttttttttagtgtatttttttatttttgtgttttttttattattatttttatgtgttggtttaattttttaattgattgtagattgtatgatgtttagttgttgttttattaatatatttcgatattgttaattaaagtttttattgtttagagttttttaataagttttttttttttttttgtttttagaggtagggttgggtttggtttttagagtttggtgatttttaggggattgaggtttatttttaatagttgtggtgtttagagagtgtttagggaaaagtgagtatttaaaatattattttatatgtttagggtttattggttttattttttatagtttttgagttttaagattttggtattggattaggagttataaggataaggtttttttttttaagtttgttaggttatttttgtttttttcggatcgttttttgtggtgaagatagaatttttgttttgaaagattttggtttagaggatattttttaggttttagtgttttttagtttttttagagaagttaatatattgaaggaatttggttttttttttgtgatttatgttttaaattttattttatatttttttggataaattttgtttgtgttttatttgttattttttaagttttttttttttttttgagatagagtttcgttttgtcgtttaggttggagtgtagtggtgcgatttcggtttatcgtaagtttcgttttttgggtttatattatttttttgttttagttttttaagtagttgggattataggtgttcgttattacgttcggttaattttttgtatttttagtagagatggggttttatcgtgttagttaggatggttttaattttttgatttcgtgatttatttattttagttttttaaattgttggaattataggcgtgagttattgcgttcggttcgtaagttttaattttttttttatttttattgtttttttaaaaaaaaaaatagtagataatggtagatattagagttttaaggtttaaaattgtgatttagaaatagtttaaataatgggttttatttgatgaatagttattgtttttgttgtttttttttttttttttttttttttttgtgagatagggttttgttggagt

SEQ ID NO: 1051 - DNA, 4770 bp, Artificial Sequence
  chemically treated genomic DNA (Homo sapiens)
atagagcgcgaggtggatagtttcgtttatttaagagttatatttagatcgagtgaattatgattttgggttttacgtttttttgttttttgtaagggggtttgttgtttacgtgttttcggtttttaaaagcgtgattatgttgattgtttttcgagttttgtggggatttagaaatttttagcgaagcgtggaaaagtagtattttgttttcgtttttttttttagtttttaaataggttatagtggagattttttttgttgtaggaaataggaattcgtggttaggtcgtgatgtacgggacgttttttttttttgtagtttcgttttcgttttttatatgaaaatgaacgagttttatattattgcgtgtgtgagattattacggtaacggcgatatttataggtattgtcgtttttacggagagggtatggaaaatttaagattgttatggaagtttagttttatattttattttttagggtggtttttgtttgaaaattgtgggagttaagatagcggtttttagtttttatagaattattggagaattttagagtgttagttttcgaagttttttttttttttttaatttggttttatatttatttattttataaggttttggtttttgtggttttcggttttggagggcgggttatttcgggattttgggtttcgagtttatgtatgtttataacggggtggaggtggtaggttttattaagggttttttggttggatttgtttgtagcgtagaggtcggttgaggtgtacgggagttcgtcggttttttttcgttcgtgttcgtcggtgaaatttcggtcggggtttttcgcgatggttttttcgatattttcggatagtatttttttcgcggaagttcgaggacgaggacggcgaaggagattcgtttggatttcgagttaaagcgaggttttgcgagtttgttttgagcggaattcgtattcgggtatcgttattagagaacggttggtttaggttatcggtatttcggagtttagggtttagatttggttttagaatgagaggttacgttagttgaggtagtatcggcgggaatttcggttttggttcgggagacgcggtttgtaagaaggtaggcgaaagcggatcgtcgttatcggattttagatcgttttgttttttcgagtttttgagaaggatcgttttttaggtatcgtcgttagggaagagttggttagagagacgggtttttcggagtttaggatttagatttggttttagaatcgaagggttaggtattcgggatagggtggtagggcgttcgcgtacgtaggcggtttgtgtaacgcggtttttagcgggtgttattttgttttttcgtgggtcgtttgcgtttatatcggggcgtggggaacggggtttttcgtattttacgtgttttgcgcgtttggggtttttttatagggggttttcgggagttagggagcgagggtcgttttcgtgttttagtttagttaggtcgcgtcggtagaggggattttttaatttgtttcggtattcgggattttgtgttttttgttttagttttttcggaagtgggattgttttatttttagatttttcggaggttttcgtattttagtaaatgataggaggattaggattcgtagcgcgacggtttgttgggcgcgtgtttagtgggatagtttgggtttttttaagttgagttataggggtaaggtgtgtttgcgttatttacgttttatcggagttcgcggtggggttggagttttaggtcgttagggcggcgtgggaattcgaagacggggtatttttattttcgaagttcgcgatttcggaggtttttgcgttaagtatagatgttagttatttaggcgttttttaatcgttttaggagtcggggcgttcgtttgtatttatttttagtttgttagatgagttttcgttaattttagatttttagtaaaaggtataattttttttagattcggtgttattgggggagttgaaggaggtggaagagtttgtttcgttggaattattttttagttaggaagaatacggggttttgttggaggagttttaggacgtcgggttggggcggggcgggggtagggcggcggtttttttttggcggtgaatttttggttcggtatggagaggcgtgtttttttttttagttgatttgtttaggatttttgggttttaggttcggcgagagattttatatagaggagggttgttatttttttttgagtatttcggggattttagggttcgtttacgtatcgggaggtggattgtttattgtttatgcgggggtttgtaggtaatagtttaggttttttaattagtttaggcggagttcgtatttttttttttttcgcgttttttagtcgggttggcggagattttagttcgcgaaatattgggtcggggtagaagttaggttagtttttttttttgcggttcgatttttttgtttttttttttattattatttgttaattcgtgttttattagttttttcgttagtattatggagcgttttgtaattaaatgtagattcgagatttcgcgtaaatcggggtgttgttttttttaggtaagagggaaggtaggtagagatgaggataggaacggagatagagtgggacggaaggatggagttaggaaaggatggatggacggagggattttggaagggagaggaagagggagagagggagaaagggaggaaaaaattagggtagggagggaagaatagagggtaggatggatcgagggataaaaggagtaagaaatagagaatcgaaggtagatagaaaaacggttttttgtttttagaattaataggatttagtaattcgggaaaatgttgggtgtttagtgcgggttaagtgttgggtttatagtttcgttggtcggtggggagtttagcggtttttcggatcgttagtttgggttattttattttagagcgatttagacgaatttcgttttcgaaggaatgagcgaattttttagagagtaatgagcggagattcgggtggttgtttgttttttatttatatggtttatagatgatatatttttacgtttagttttgtaatagagcgcgaggcggatagttttatttatatagaagttacgtttaggttaagtgaagcgtgattttggattttacgtttttttgttttttgtaaaggtgtttgttatttaagtttttgtcgttttcggaaagcgtgattatgttgattgtttttcgagttttgtggggatttagaaatttttaggaatgcgtggaagattagtatcgtgtcggtgtttttttttttagtttttaaataggttatatcgaagattttttattttgtagaaaataggaatttatttttaggtcgtgatgtacgggacgtttttttttttttgtgttttcgtttttattgtttatatgaaaatgaacgagatttatatatttgcgtgtgtgagattattacggtaattatgatatttacgcgttggtaatagagttggtagtttgattttaggataaaggtattgacggatatttagatatattttattataattattagtaaatttatttttaaatagatatatacgggcgtacgcgcgggaatataagtatatacgtagatatataaagatatagatagtttgaagaagagtaagggatagagggatggagagatagaaacggaaggagagagagaaatagcgatagagagagagatagagagggacggggaaattgcgagagagagagagagagagagagagagagagagatagagagagagagagagatagagagggacggggaaattgcgagagagagggagagagagagagagagagagtaaggtggagagggaagtagagaaagggagagggtgagggagttagagagggggagtaatagagttttggagagggaggttttgttttggtagataggggattttttggcgagggtagggtggagggtgtttgggtcgggttagaataggagggtagggtcgtttacgcgggaaaattaacggagttttgagacgtgtttttatttggattggttggttgttttgggcgtgcgttttttagcgttatttttttgttggtttttttttgtttttttggtgttgtgggttttgaaagttgtcgagtgcgtttgtttttgtggtgggagtagtggcgtcgagcgtgtttacgggtcgtcgtttgggtttttttcgtgtttagggtagtatggacgtggataatggtagtggtttttggttggtttaagagtcgggtttagatacgcgcgtttgattttaggcgttataattaattcggggtcgcgaggttgggattaggtatttcggagtcgtttgttcgtggtcgggttgttttttttttttaagtttaagtatcgttagtcgcggcgttgcgtttttcgtcgattttttagagcgtttcgtcgtcgtcggcggttagtttcgcgtaggattagtgtggcgtcgttttgttgttgttggggggcgttcgaggtttttattttttgtttaggttttcggttttcggggcggtttttttttcgtttacgttttagggttttttcggttttcgagtttcgagtttttattatatcggtcggtttaggataggtatgtttatttcgttattttttaattttttgttgtttttatttatattttattgtgttatgttttgaaatgttgttgtagttattatt

SEQ ID NO: 1052 - DNA, 4770 bp, Artificial Sequence
  chemically treated genomic DNA (Homo sapiens)
agtaatagttataataatattttaagatatagtataataaaatataaatagaaataataaaaagttaaaaagtgacgggatgagtatatttgttttgagtcggtcgatgtggtggaagttcggagttcgggagtcggggaagttttggagcgtgggcggaagggaggtcgtttcgagagtcggaagtttgggtaaggaatggaggtttcgggcgttttttagtaatagtagggcggcgttatattggttttgcgcgaggttggtcgtcggcgacggcgggacgttttgggaggtcggcggaaagcgtagcgtcgcgattggcggtgtttaggtttagagggggagagtagttcggttacgggtaagcggtttcggggtgtttgattttagtttcgcggtttcgggttggttatgacgtttggaattaggcgcgcgtatttggattcggtttttgggttagttaggggttattgttattgtttacgtttatattattttgaatacgagagaaatttaagcggcggttcgtgggtacgttcggcgttattgtttttattatagggataggcgtattcgataatttttagggtttatagtattaagaggatagggaggagttaataaaggaatgacgttaggaaacgtacgtttaaagtaattaattaatttaagtaaaaatacgttttagggtttcgttggttttttcgcgtgggcggttttgtttttttgttttagttcggtttaggtattttttattttattttcgttaaagggttttttgtttattagagtagagtttttttttttaaggttttgttgttttttttttttagtttttttattttttttttttttttatttttttttttattttgttttttttttttttttttttttttttttttcgtagttttttcgtttttttttgtttttttttttttttttgtttttttttttttttttttttttttttttttttcgtagttttttcgtttttttttgtttttttttttatcgttgttttttttttttttttcgtttttatttttttatttttttgttttttgtttttttttaagttgtttgtgtttttgtgtgtttgcgtgtatgtttgtgttttcgcgcgtgcgttcgtatgtgtttgtttgggagtgggtttgttagtgattgtggtggggtgtgtttggatgttcgttagtatttttgttttgggattaggttgttaattttattgttagcgcgtgggtgttatagttgtcgtgatagttttatatacgtaggtgtgtggatttcgtttatttttatgtagataatgagagcgaaagtatagagaaaaagaaacgtttcgtgtattacggtttgaggatggatttttgttttttgtaaaatggggagttttcgatatagtttgtttgaaaattggaaaggagagtatcgatacgatgttggttttttacgtatttttggaagtttttgggtttttatagagttcgggaaatagttaatatggttacgtttttcgggggcggtagagatttgagtaataggtatttttgtagagagtaaagaaacgtggaatttagaattacgttttatttggtttgagcgtgatttttgtgtggatgggattattcgtttcgcgttttgttgtagggttaaacgtggggatatgttatttgtgaattatgtggatgaaaaatagataattattcgagttttcgtttattgttttttggggaattcgtttattttttcggaaacggaattcgtttgaatcgttttgggatgaagtaatttaggttggcgattcggagggtcgttgagttttttatcggttaacggggttgtgggtttagtatttagttcgtattgggtatttaatattttttcggattgttgggttttgttggttttggaggtagaagatcgtttttttgtttgttttcggttttttgttttttgttttttttgtttttcggtttattttgttttttgtttttttttttttgttttggttttttttttttttttttttttttttttttttttttttttttttagggttttttcgtttatttatttttttttagttttattttttcgttttattttgttttcgtttttgtttttatttttgtttgtttttttttttgtttggaaagggtagtatttcggtttgcgcggggtttcgggtttatatttagttgtaaggcgttttatggtgttggcgaggaggttggtgggatacgggttggtaagtgatagtgagagaagaggtagaggaatcgagtcgtagaaaggagaattggtttggtttttgtttcgatttagtgtttcgcggattgaggttttcgttaattcgattgaagaacgcggggggaaaagggatgcgagtttcgtttgggttggttagaaaatttaagttgttgtttgtaaattttcgtatgagtagtagatagtttatttttcggtacgtggacgggttttgggattttcgggatgtttaggaaagaatgatagtttttttttgtgtggagtttttcgtcggatttggaatttagggattttagataggttaattggaagggaagatacgtttttttatatcgagttagaggtttatcgttaaagagaggtcgtcgttttgttttcgtttcgttttaattcggcgttttaaagtttttttagtagagtttcgtgttttttttggttgaggagtggttttagcggagtaggtttttttattttttttagtttttttagtgatatcggatttaggaaaggttgtgttttttgttgaaagtttggggttgacgggagtttatttaataggttggaggtgagtgtagacgagcgtttcggtttttggagcggttgggaggcgtttggatggttggtatttgtgtttgacgtagaggttttcggggtcgcgagtttcggaggtggaggtgtttcgttttcgggtttttacgtcgttttggcgatttggggttttagttttatcgcggatttcggtgggacgtgggtggcgtaagtatattttgtttttgtgatttagtttgagggggtttaagttgttttattgagtacgcgtttagtaggtcgtcgcgttgcgggttttggtttttttgttatttattggggtgcggaggttttcgaggagtttgagggtgggatagttttattttcggaggagttagggtagggaatataaagtttcgagtgtcggggtaggttgggagattttttttgtcggcgcggtttggttgggttggagtacggggacggttttcgttttttggttttcgaaagttttttgtgggagagttttaggcgcgtagggtacgtgggatgcgggaagtttcgttttttacgtttcggtgtgggcgtaggcgatttacgagggagtagggtgatattcgttgggggtcgcgttgtataggtcgtttgcgtgcgcgggcgttttgttattttgtttcgggtgtttggtttttcgattttgaaattagatttgaattttggatttcgggaggttcgtttttttggttagtttttttttggcggcgatgtttggaaagcgattttttttaaaggttcggaggagtagggcggtttgggattcggtgacggcggttcgttttcgtttgtttttttgtaggtcgcgtttttcgggttagggtcgagattttcgtcggtgttgttttagttggcgtgattttttattttgaaattaaatttggattttgggtttcggaatgtcgatggtttgggttagtcgttttttggtggcgatgttcgggtacgggtttcgtttaaagtaggttcgtaggatttcgttttggttcggggtttaaacgagtttttttcgtcgttttcgttttcgggttttcgcggggagggtgttgttcgaaggtgtcgggagggttatcgcggggagtttcggtcggaattttatcgacggatacgggcggagagaggtcggcgggttttcgtgtattttagtcggtttttgcgttgtaggtaggtttagttaggaggtttttagtaagatttattatttttatttcgttatgaatatgtatgaattcggggtttaaggtttcggggtagttcgttttttaaagtcgaaaattatagggattagggttttgtggggtgggtgggtgtagggttagattggaggggaaaaaggggtttcgggggttggtattttaaggttttttagtaattttatggaaattggaagtcgttgttttgatttttatagtttttaggtagaaattattttgaagggtggagtgtggaattgaatttttatgatagttttgagttttttatgtttttttcgtgaaggcggtaatgtttgtgggtgtcgtcgttgtcgtgatagttttatatacgtagtggtgtggaattcgtttatttttatgtagaaaacgagagcgaaattatagagaaaagaaacgtttcgtgtattacggtttgattacggatttttgttttttgtaataagggaagtttttattgtggtttgtttggaaattggaaaggagagcgaagataggatgttgtttttttacgtttcgttggaggtttttgggtttttatagagttcgggaaatagttaatatggttacgtttttgggggtcggagatacgtgaataataggtttttttgtagagggtaaaggaacgtggaatttagaattatggtttattcggtttgagtgtgatttttgaatggacgggattatttatttcgcgttttgt

SEQ ID NO: 1053 - DNA, 6308 bp, Artificial Sequence
  chemically treated genomic DNA (Homo sapiens)
ttatgaagagtatttatttgttatattatttagaattagttggtataaggggttatttttgaagataggtaaatttttttttttttgtttaaaatttaagaaatgttgtggtgaagagagatagtggagatagaaatgaaattaaatttgatgggtttgggtttaaatttagtttaattatttattagttgtgtgattttggtaaatttattttttttttttgagttttaggttagtgagtaattagtagggttataaggtttgtgatgtttaaagtagtttggttaagaatttgttgatttttttttttatttttttgtttttatgtagtatttttttatttatttaataaataaatatttatgtttggtatagtatgttgaatagatagttttttttttagaggaagtgataaaagtgattttttttagatggaaaaattgaggtttagaagttaagtggtttgtaagagttttgagatatttggatttttttgttattagttagaagagttttttattgaatttttgtttagttatattttatttttatggtttatttaagattttgggagttttttttgggaatttttttggggttttattttaagtgagggtttaggaagggtgaattaagttgtttggatttatggatttaataggtgtggggtggaaggtttttttttgttgagggtgtggtttagtgttattttgtttagttttagtgggatatttttatagttagtaggaagggtagtttaaaatttagtgttatttttgtgttttagttaagaaaataagggttatttaggtgtttttttagttgatgagatggaaaaattaaagtataatagataaagagggattgttttaaaagaaaaaggggatttgaaaatattgtagattagggggaggaaaggaggtggaaagaaataatgttttatatataggaggggttttataaataatttgttgaaaagaaattgttttgtggatgttataaagatgttttgtaggataagtttatttatatagaaaaaaagaaattttatttagggagttgttggtttttagagtttttattttttattttttaattttgtggtgtgtgtgttttttgttagattttagtttggggtttttttttggtttttagattttttgtttttttggttgtgttttttgtttggttttgagggtaaatttgtttttgtggaatatatttttgtgagattgggttaaagttttggggtttgtattttttgtaaaggagagtttttgagattggaggtttattttaatttttgtgtttgagtttgggtttggagaaaagtgttttttttttggttttggttttgttattgtgggggattggtgggaggagtaggggaggttggtgggatattttgtattaggttgtttatttataggggtgtttgggttaggggagtagatggagagtgggggtggtttttgatttttttgtgtgttggggttggggttgggttgggggtttggtttgtttagttaatgggtgttgtgtttgggtttttttttttgtattgggaggggttgaggttgggttgttgttgttgaggttgtgtgtgatgtgttgtttttgggttttgtgtttttagttttagtagggttgtgtggatggtgtggtgtttttggaaggaggttatgtgtttagtgttggtgttaattatgtatgtggtgttttttggtttgttagatttgaagtttatttttattgtggttagtggtttggtggggtgttgtgtttgggatttgtattgagttaggtttggagaggtgtgtggtttgttttgggtgtatagtgtagtggggtggtgggggaggttttggttggtgtaaggtgggtaggagtttgtgtttttgtttttggtgggagggtttgtgggtgtgtgatttattttgttgttgggttttatggtagtgttgtgttggtggttttggttgtgttgggtatgtgggtggtgatgggtgtgtgagtggtgtttttttgtttaggtttgtgttttggtttggggatttttattgtgattttgattttgatttttgttgtttggttttttgttttttggtgtgtttatttggggatttgtgattagtgattggtatgtttgttgttgttattttttgttttttgttagagagtgtgtggattgtagtgtttataggattttggttattggttggtgatgttggtgtgttaggggtgtgtgggtaggattttggggtggggtttggggtttagtttgttttgggtggtgttttgtggggagggggtgaggggagtggttggggttggggttttttttaattattgttttgtttaggttgttgattggtttgttttttttgtgttgggattgtggagggtatttgttgtgtgatttagggtaagtgtgtgtatttttttgagtttttgtggttttttttagtaaaatggtggagttggtatttggttgtaaggtaagttgggatgtgtggagtagtgggtggaaagttggattggagtttttatttggttgttgggtgattttggtgtattagggatagtaatagtattattttgtagggttgtagaaagattaagtgagttaatatttgtaaagtgtttagaatagtgtttattgtatggaaagtagtatttatttgttagagagattttaggaggttttgtttagggattgattttttttttttttgtttttattttttatatttttgtttgtgagttaagttttgtttttgtattggttgggtttttttgtttggaaatgtatatttattttaaatttgggttttaaaattattttttttgggatgtttttttttattttttatagtttaggtgagtttatggtgatttgtaagtgtggaaaatatgaaaggtaggttaattgattgatatgataggatattaaggatatgatagattttgggtttgaattagtttaattgtatattggtttggttgtgattttgggtgagtttttggttagtgaggttgtttttgtttttttttttaattttttttttttttagatagagttttgttttgttgtttaggttggagtgtagtggtatgattttggtttattgtaatttttgttttttggatttaagtagttttttgttttagttttttgagtagttgggattataggtgtttgttattatttttggttaattatttttatttttagtagagatggggttttattattttggttaggttggttttgaatttttgattttgtgatttatttattttgttttttaaagtattgggattataggtgtgagttattgagtttggttgaggttgtttttttatgagtaaatggaatttttatattaattttattgttattaggagaggtgtaatttttagataagtttatgaagtgtttagtatggaagtttttatttattggttggtggtattgttggtttatttatttagtttgttagtaaataaataaatgttggttttaaatttttgggtttaagtgatttttttattttagtttttgtagtagttgggagtgtaggtatgtgttattgtattggtagtggtattgttattatttgattttattttattttttttagattagtgttttatttgagatatagtgaagggaaggatttttagtttaaaggtttgattaaagttttgagggttttttttttgatggagggagttatggtgggtttattgtttgttggaaattgggaggttgagttgattagatgatttttggagttttttggtaatgtgtttagttttggttgaggggtattttggttgagtatggagttttgaaatagaaggtaggtgtattttgggtatttttttgtttaaggttttaatttttgtggtttttttatgtttagtttggaaagtttgggttatttttttttttatttttggatagattaagttttgttgattttgttgtttatattattttatttttttttttttttttgttgtttgtagggtttttattttttttggttttttgttttttagttttgtattttgttatttttttgtttatttgtttgaaattgttatggagggagtaagggttaagtttggttattatggtttttttttatggtattagtttatatgtttagttttgttttttatattagtaatttatatttatatatttgtttagtttgttttttttgtttgggaagttttttttgattttattatgttaaaaagtattatgggtttttttttttttgggaagtgtttttggtttttttaagtggaaattttttttttttttattatttggtgttttgtaggttgttatttgttttttgtttgtttttttttagtttgtgagtattttgaggataggttttgtagttgaggtatgtgggtgaatgattgaaggagggaaggaatgtatgaatgagtgagtagttaatttatttgtgttgaatgtttttttttttttagtttgttttgttgatatttttagtttttttttaagtattttttgggttttgttatttttttttttaaagtttttttatagttttttgttttttagtatatttagtttatgtttttttttagttgtgggtttgttttatttagtttatgggttatatttattaaatagttattttgtttttttttgggttagttttatgttggttatttttttagggatagagatatgtgattttattgttagttttatggaggttttaagttggaggaggagtaagaggggaaatgagtagtaataatattaagttaagtgtagagggttaagaatttgtataggtgtagaatttgtattataggggaaggagagtgagtagagagagtatttgggaagggggaggttatgttaagtagggtttggaagattgaataggagtttattagatggattgagggaaggttatttttagtagagagaagagtatgtgtaaaggtagtagattgttagaatgattatttagggaatgtgagaatttttgggttatttttagagatttatgatggagttttagatttggattttttgagttttagttttgttatttatttgtaaatatttatgggtaaataatgtttttttttttttgagtttgaagatttatatttgtaaaatagatataataaattttttttgggtaggtttgagggaaagtggatgtttataaaggtttagttatgtaaattgtatttatttttgatgtgagaagtttagttaaatttttattttatggtagggtggtgtttgaggaaaaagtatagtggttaaaaaaaagttttttttttatttattttattttatttgtttatatatagatttttattattttttttgtgtttttttttgtgaatgttttatgatttttggaggttattggttagaagtaaatttattagaagttattgatgttgtattatagattagatttttaggtggattggtttgttatttgggtggttgattttttggaagtagaatttaattttaattagggaatgagttttagagaaggttttaggaaatagtatatgagtagagaaggtttgggtgtaaggggaaaggggagtaggaggggtatttaagtagtttttgtggttggggtatgggggtttagggaggagaagagattgaagaagtggaattatagaggtttttaaatgttaggtataggagttagggttttatgtagtgggtagtggtgagttatggagagttattgagtagggaaaggatttgaggaaattttagtgtttttataagtttattttatttgaggtattaaagggggtgtgaggaggttgtggaattttagtatttagtttgaatgatttagtgttttttttttagtttgtgtttatattgatagttttattttttggaggttgtttttagttttggatggaatttggttttttttgggtttgattttaagtagttttagttttagttagtttggaggaaaagagttttttgggattggttagtagggaggtgttaggtgttaggtggatgttggagtttagtgtgtgttttagagtatgtaagtgggtgggggaggggtggtggtggtgatggtggtggtggtagggttgtgtagggtgggttttagtagttttagagttaggagtgagtaaggtgggttgggaaaagattttgttgtttttaaaggtaagtgtttttggtagttaggaggaaaggttttgttgagttagttataattggtataagaggggatagtagg

SEQ ID NO: 1054 - DNA, 6308 bp, Artificial Sequence
  chemically treated genomic DNA (Homo sapiens)
tttgttatttttttttgtattaattgtagttgatttagtaaaatttttttttttggttgttagggatgtttgtttttaaaggtaatagagtttttttttagtttgttttatttatttttaattttggagttgttaggatttgttttgtatggttttgttattattattattattattattattttttttttatttatttgtgtgttttgaggtatatattaggttttagtatttgtttggtatttgatatttttttgttagttagttttagagagttttttttttttagattagttggggttggaattgtttagaattggatttagaagaggttgagttttgtttaggattaaaggtagtttttagggaataaagttgttagtgtgggtgtagattagggaaggggtattaggttgtttaagttgaatgttggggttttatagtttttttatattttttttagtgttttaggtagagtaggtttgtggggatattgaggtttttttaggttttttttttgtttaataattttttatggtttgttattatttattgtataaagttttaatttttatatttggtatttgggagtttttgtgattttatttttttagtttttttttttttttaagtttttatgttttagttataggggttatttaggtgttttttttgtttttttttttttttgtatttaaattttttttgtttatgtgttattttttggggttttttttagggtttattttttagttggagttaaattttgtttttaaggaattagttatttaaataataaattagtttatttgagaatttagtttgtgatgtagtgttaatagtttttgatgaatttgtttttgattagtagtttttaggggttataaaatatttatagagaggaatatagagaaggtaatgggggtttgtgtgtgggtaggtggggtggggtgggtgaaggaaaagtttttttttggttattgtgttttttttttaagtattgttttattatgggatggggatttgattgaattttttatgttaagaatgagtatagtttatatagttaagtttttataaatatttatttttttttaggtttatttaggaagggtttgttatatttattttatagatgtgggtttttaggtttagagaagagaaggtattgtttgtttatgaatgtttgtaagtaaatagtagagttgggatttaaagagtttggatttggggttttattatgaatttttaagagtggtttagagatttttatgttttttaggtaattattttggtagtttgttgtttttgtatatgtttttttttttgttgagaatggtttttttttaatttatttggtgaatttttatttagttttttaaattttgtttagtatgatttttttttttttagatgttttttttatttatttttttttttttgtggtataagttttgtatttgtatagatttttaattttttatgtttgatttggtattgttgttgtttatttttttttttgttttttttttagtttggggtttttatgaggttaataatggggttatatgtttttgtttttgggaaagtggttagtatggggttggtttagagaaggataaggtggttgtttggtgagtgtgatttatgggttgagtaaggtagatttgtaattgggaaaaggtatagattggatgtgttaagaaataaggagttgtggagagattttgaggagggaagtagtaaaatttaaaaggtatttaaggaaagattggaagtattagtaggatggattggaggggaaggaatatttaatataggtagattagttgtttatttatttgtgtatttttttttttttttagttatttatttatgtgttttagttgtagaatttgtttttaaggtgtttataggttgagggaaggtagatagaggataagtggtaatttataaaatattaaatggtaaaggagagaaagatttttatttgggagaattagggatattttttggaggaggaaggatttatggtgttttttggtatggtgaggttggggagggttttttaggtagaggagataagttgagtaaatgtgtggatgtgagttgttggtgtgaggggtgaggttgagtgtgtaaattggtgttatgaagaaggattgtgatggttaggtttggtttttattttttttatgataattttagatagatgagtaggagagtggtagggtgtaggattggaggataaaagattagaggagatggaggttttgtagatagtaggggagggaaggaggatgaggtggtgtagatagtggagttagtaggatttggtttgtttaggggtgaggagagaggtggtttaagttttttaggttgagtatagagagattataggaattgaagttttgggtaggggggtgtttagaatgtatttgttttttgttttagggttttatatttaattaaggtgttttttagttagaattggatatattgttagagaattttaggggttatttggttggtttagttttttggtttttgatagatagtaagtttattatgattttttttattgggaaagggatttttaagattttgattagatttttggattgggggtttttttttttattgtgttttaagtaaggtattggtttagaggaaataaggtgaagttagatgatagtaatattattattagtgtagtggtatatgtttgtatttttagttattatggaggttaaggtgggaggattatttgagtttaggagtttgagattagtatttatttatttattaatagattaaataaataaattaataatattattaattagtaaatgagaatttttatgttaaatattttatgagtttatttggaaattgtattttttttgatagtaatgagattggtgtgggaattttatttatttataagaagatagttttggttgggtttagtggtttatgtttgtaattttagtattttgggaggtgaggtgggtggattatgaggttaagagtttaagattagtttggttaaaatggtgaaattttgtttttattaaaaataaaaataattagttaggggtgatagtgggtgtttgtaattttagttatttgggaggttgaggtagagaattgtttgaatttgggaggtggaggttatagtgagttgagattgtgttgttgtattttagtttgggtgatagagtgagattttgtttgagaaaaaaaaaaattaaagaaaaaaatgaaaatagttttattggttaggaatttgtttaggattgtggttgggttagtatatagttgagttggtttaaatttgaggtttattatgtttttaatgttttattatgttagttagttagtttgttttttatattttttatatttataggttattatagatttatttgaattgtgagaagtagaggaaggtgttttagaggaggtgattttaaagtttaggtttgagatgggtatgtatttttaggtaagagagtttggttggtgtaaaagtaaggtttggtttataaatgggaatgtggggggtggagatagggaagggagaagttaatttttgggtaagattttttggagtttttttaataaataaatattattttttatgtagtagatgttgttttaaatattttataaatattaatttatttggtttttttataattttatgaggtggtattgttattatttttagtgtattgaagttatttagtggttgagtgagaattttagtttagttttttatttgttattttgtgtattttagtttgttttatagttgggtattggttttattattttgttagagaaggttgtggaggtttagagaggtgtgtatatttgttttgagttatatagtgaatgttttttgtggttttaatgtagagagaatgagttgattggtagtttgagtgaggtagtggttagggggggttttggttttggttattttttttattttttttttgtagagtgttgtttaggataggttgggttttaggttttgttttgaggttttgtttatatatttttgatatattggtgttgttagttaatggttggggttttataaatgttatggtttgtgtgttttttggtaagaggtaagaggtagtaatagtgagtgtgttggttgttagttgtgggtttttgagtgagtatgttagggagtaggagattaaatgatgggggttggagttagagttgtagtgggagtttttggattggagtatgagtttgagtgggagagtgttgtttgtatgtttgttgttatttgtgtatttggtgtagttagagttattagtgtagtgttgttatggagtttagtagtaaggtgagttgtgtgtttgtgggtttttttgttaggaataaaggtgtagatttttgtttgttttatgttggttagggttttttttgttgttttgttgtgttgtgtgtttggggtgggttgtgtgtttttttgagtttggtttggtgtgggttttgagtgtagtgttttgttgggttgttggttgtagtggggatgggttttggatttagtgggttggagggtgttgtgtgtgtagttggtgttggtattgagtatatggtttttttttgggggtgttgtgttgtttatgtggttttgttggggttggggatatagggtttgggagtggtatgttgtatatgattttggtagtagtagtttagttttggttttttttggtgtgggggagggggtttgagtgtggtgtttattggttgagtgggttgagtttttggtttggttttggttttggtgtgtggaggagttaggagttgtttttgttttttgtttgtttttttagtttggatgtttttgtaggtgggtggtttggtgtgaggtgttttattggttttttttattttttttgttagttttttgtggtgatgaggttgaggttgaggggagggtatttttttttaggtttgggtttgaatgtgggggttgagatgaatttttggttttggaggtttttttttgtgaggagtgtaggttttaaagttttggtttagttttgtggagatgtgttttgtggaggtaggtttatttttggggttaggtggggagtgtaattggaggggtgggggatttgggggttaggaaagagttttaggttgaagtttagtgggaagtgtgtatgttatggggttggggaatgagggatggggattttggggattaataattttttagataggatttttttttttttgtgtaagtgggtttgttttgtagggtatttttgtagtgtttgtagagtgatttttttttaataaattgtttgtggagttttttttgtgtgtagggtattgtttttttttatttttttttttttttttagtttataatatttttaagtttttttttttttttgaaatggtttttttttatttattatattttgatttttttattttgttagttgggagggtatttggatggtttttgtttttttagttgggatgtgggggtagtattgaattttgaattgttttttttattggttgtggaggtgttttgttgagattgagtggggtggtgttgggttgtatttttggtaggaaaaggttttttgttttatatttgttgaatttataaatttagatgatttggtttattttttttgggtttttgtttgaggtgagattttggggaagtttttggggaaggtttttaggattttaggtgagttgtaagggtgggatataattaaataaaagtttagtgagaagtttttttagttagtggtaaggaagtttaaatattttagggtttttgtaggttatttaatttttgggttttagtttttttatttgaaagagattatttttgttattttttttagggaaggaattatttatttagtatattatgttagatatgggtatttatttgttgagtggataagggaatattatgtggagatagaaaagtggaggagaaaattagtaggtttttagttaaattattttaagtgttatggattttatagttttgttggttatttattagtttggagtttagagaagggaaataagtttgttaaagttatatagttagtaagtggttgaattggatttgaatttaggtttattagatttaattttatttttgtttttattgtttttttttattataatattttttgaattttgggtagaagggagagagtttgtttatttttaaaggtggttttttgtgttagttggttttaaatagtgtagtaggtgggtgttttttatgg

SEQ ID NO: 1055 - DNA, 6329 bp, Artificial Sequence
  chemically treated genomic DNA (Homo sapiens)
tatttgattgtgtttgttggtattttttttaagggtatagagttggggtttttgatttgatttttatgtatggatttttaggtggtattagaggagttatggagttagtaaagtttttaagagtttatgtaaaattttatttttgtgtatagggttttgatttttaggggttgtgaattaaggaaagttaaaaattattggtttagtgttatatataaaataggaatttattgaaggtgtttgtgatatttgttatttgaggtgtagaataaagggtgttatttatttaaagtaaaagtaaaatatgggttgggtgtggtggtttatgtttgtaattttagtagtttgggaggttgaggttggtggattatttggggttaggagtttgagtatagtttggttaatatgatgaaattttgtttgtattaaaaatataaaaattagttgggtgtgatggtgtgtgtttgtaattttagttatttaggtggttgaggtaggggaattatttaaatttgggaggtggaggttgtagtgagttgagatggtgttattgtattttagtttgggtaataagagtgaaattttatatttgtattttttatttattaaaaaaaaaaaagaaaagaataaaagaaaatgtgatatgatggttagaagttgtagttattaagggttagattgtttattttttttattttttagtttagataaattaaaggagatttaagagagattttgtttaagattataaattatagagttattaagtggtaaagttgagtattaaagtttattggatttttattaggatgttagggtatgaaattatgtttatatttttttagaatgggtttgattaaaatttttttaatttttgtaaatattttattttattaagaaggtagttttttaaaattttattgtattttttttgagatggagttttgttttgttatttaggttggagtgtagtggtgtgattttggtttattgtaatttttattttttaggtttaagtaatttttttgttttagttttgttagtagttgggattataggtgtgtgttattatatttgtttaatttttgtattttttagtagagatggggttttgttatgttggttaggttggttttgaatttttaattttaggtgatttgtttatttttgttttttaaagtgttgggattataggtgtgagttattatgtttggtttagttttttaaaattttaaaattaagtttttatatagaatttgatatatttaaatattttttaaattattaattaagttatggattttttataaaagttgtatatagattttttattttattttttttttgagatggagttttgtattgttgtttagtttggagtgtagtggtatgattttggtttattgaagtttttatttttttggtttaagagatttttttgttttagtttgttgagtagttgggattataggtatgtgttattatgtttggttaatttttgtatttttagtaaagattgggttttattatattggttagtttggttttgaatttttgattttatgatttatttgttttagttttttaaagtgttgggattataggagtgagttattatgtgtagtttagtatatagatttatgaggtgaattttagaggtttattattttttattttatgttatgaatataattttaagaagtaatataggggttaggtttatatttgtaattttagtattttgggtggttgaggtgaatatgaggttgattatgaggttaggagtttgagattggtttggttaatatagtgaaattttatttttattaaaaatataaaaattagttggatatggtgatgggtgtttataattttagttatttgggaggttgaagtaggagaattgtttgaattggggaggtggaggttgtagtgagttaagattgtgttattgtattttagtttgagtgatagaggtagattttgtttgaaaaaaaaaaatgtagtataggttataagtttattgagtgaggtatttttaaatgtattagggaagatagttattgatagttgattttggggtggatttgtataattttaatttgtaagttgtaggatttttttaagttttttttttatgttaatattaatagtgttgtttaaatattaaatgttttttttttaatttaggtaatggggttatttataaattaaattgagaataatttttttagttttatgtttataaatattatatgtagtagaattaaagatattaggtaattattttgagattagattaaaaaataattattgttataaaaaagttatagaattatttgttttaatgttaaattttgttttagtatatgaaatttaaagtaattaaaaatttagttttatttgggaagggaaattaaagtgatatttgaatttaagtttaatgataatatgttttttaattttaaagtgagtgtattgttttatttatttaaagagttttaatggtataatattttatagtatatataaaattttttaaggtgtatattatggtaaagtttttgattgtttgtgaattatatttagttttttttgttagttttttttgtagttttttatttttaaaaggtataattggaataggttttagggagtatttgtggtttgaaaaggttgtgattaatttttagagttttattggttgtaatttataagtaggtttgattattttattttggattaaggagattttgttaatttttaagtgattgtaagtggataagattaatttgggagaaaatgttgtgagggtttttttgttaagttagtagtttttattgttatattttgaaaagggtgaagatttggttattatttaggtggtgaaagaatatggttgggttgtttgggggtttatgattgtttgttggttggtgattttgtagtttgggttgggttgtggtgttgggagtatgtgaagaggtagggatttttggggtatgtggagagggaattagaatgaggttaggagtttgtaggtgttgtttagggaggggatgaggttgtttagggttggtatggttgagtgagattgagagtgtggttttggatttggatagattggttatatttttgggttgtgattttgagtatatgatttgattgttgtgtgttttagtttttttttttttaaaatgggggttgtttaagtggaaaatgtgttttggagtgtttggtatggtgtttggtgtatagtaagtgttttttttatgtgagtgttttggttttttttgttgttgggaggaattggggaagttttgtgtggggagtttttgggaggtggatttgaggttggggtaagggaattgggttggggatttattgagtatgtttgtggaatggtgttgggttatgaagtatgtgttgtttttgtagtatgtgttttttttgaggaggtttttatggaagttttttttgaagttgtagttggttgttattagtttgtagttgttgttgttgttgttgttggttttggggttggtttgtgagaggttgttgagtatggtgtgggttattagttgtttgtatgagaggattgagaatattgttgttgttgtttttttgaggaggtggggggttgggggagtaggaggatgtggaggtttggagttggttttttttttagttgtagttgtgttgttgttggggtgttttttagggtggtgtgtagtggttgttgttgtttttgtttgatgtgtggggttttgtatgtgtttagttgtgtgtattggagttagagtgaggttagaagtggtggtttttttgttttagtttaattgaagttttggttgtagtggttgttgttgttgttgttattttttgttttattagtgtgttttgggtggtgttggtagtattgttttttttttggttttgtttttagttttgttttgatttattgtttaggtttaagtttagttttttgggtttgttgttttatgtagttattaaggttgaatatgtgtagagggtgtggatgtagtgttttttgggaattatagttttggagttgtagttatttttgatttggttgttaaagatttaggatttagggggattttttagatgtgggatttatgttaagttagtaggaattgtaggtgggttatgtgagggttttttattttgttttaattgtattttttaaagtttgttttaaataaataatgttattatttttttaaataaaaatttgtaagaaattagaatggagttatataatgagaaatagaggtatatagatttagtgatatttttttaagtaatatattggaaggatttagggtggtaaattgtttggaaagaagagattttttgtagttttttaggaaaaattgagaaaatgttatgtgtttttattagagtgggaggggatatagatggtgttatgttttttttgttaattggtttttagttatgtttatagttgttttaagatttttgtttttgtttttgtttttattttttggaatgtaatttgtttatttgagggttttgtgttttttgttgttgtatttttagaatatgtgagtatttagtaaatatgtgaatgaatgaaagaatgaatgaatattttattagattttaagttttttaaggataaggattatttgttgtttaattattagaatttaaagtaatgtttggtatatagtaggagagtgtgtaaatgtttgtggaataaaagaaggaataatgggttgggtgtggtggtttatatttgtaattttagtattttggaaggttgaggtgggtagattatttgaggttaggagtttaatattagtttggttaatatggtttttattgaaaatataaaaaaaaattagttgggtttggtgataaatgattgtaatgttagttatttaggaggttgagataggagaattgtttgaatttgggaggtagaggttgtagtgagttgagatagtgttattgtattttagtttgggagatagagttggattttattttaaaaaaaaaaaaaggaaggagtaatggaataagaatataaatgataaaagaaagttatgtttgttgaatataggaatgattgagtgaatggggtttataaataatagaaaatgagttttggggtaagtaatttaatttagagtaatttttagtttgattgaaatatatattttttagaaatagtagtttttttttagtttatttttaataagattattgttattttggggatttttattttgtttttaaatggtttttttttatgtttttttaatatatttaaaatgttgttaattattaatttaatatatattattttgttattttaattattgttattattaaatatttttgtagtttatagtgtgttaagtattgtttatatatatgtttttgtttttaagagtttttattaaaattggatggaagaaatgattttatgtagtggtattttgttaaatatatagaatttagaaaatgtttatttattggataaatggtatagtaatgataataatgtatttatattttttttttttttaatggtataagaattggagagtgtttagaagagggggtagtgttttttggaattttttatttggtatttatattgttgttagttgtgttaaaggtagtttttttaagtatatatattattattagattttagttagtttggtaggtaattttattttaaggataaattttttaaaatagtatgttaattttattttttgttttgttaaatttttttagattgtttttattttttttttttagggtatatattatttaatttttatgttagttataagaattggtttgatgggatgagtaggaatttaaaatgtgattttaaagttagtaatttttgttttgatggggttgttgtttttatgattaagtgatattagtgttttgagtttttggtaaatgaattttttgtaagtgagttttttgtaaatgagttgtttatagaagtatgtggtgaatagaattttttttaaagtttttttgtaagttttaaaggaataggagatagggttttgggtttttttgaattatttattttagagttagttttgaagttttattattatgggggaagttaggagagggtattttataaaatatttttttttttgtttttttttttaggaatataatttatgtttgatattttgttggatttaaaaaggtttggatttttttttttaatagagttatatttttagtattttagggatttttgagaggttagttgttatttttaaaggtgaataagtgtg

SEQ ID NO: 1056 - DNA, 6329 bp, Artificial Sequence
  chemically treated genomic DNA (Homo sapiens)
tatatttgtttatttttaagagtggtaattgattttttaggaatttttgaagtgttaggaatgtaattttgttaaggaagaaaatttaggtttttttaagtttaataaaatgttaaatgtgaattgtgtttttgggagaaggaatgggaagggaggtgttttgtaaagtatttttttttggttttttttatggtgatgaaattttagagttggttttggaataaatgatttaagagaatttgaggttttattttttgtttttttaaaatttgtaaaggagttttgagaaggattttgtttgttatgtgtttttgtgggtaatttatttgtaggaaatttatttgtaggaaatttatttgttggaaatttaaggtattggtattatttaattatgaaaatagtagttttattggagtagaagttattggttttagagttatattttaggtttttatttattttattaaattagtttttgtgattgatatggaaattaggtaatatatgttttgaaaaggaaaagtaggagtagtttgaaggagtttgatgaggtaagaaatagggttgatatgttattttaaaaagtttgtttttggggtagaattatttgttagattgattgggatttggtagtggtatgtgtatttgaaagagttatttttagtatagttggtagtaatataaatgttaagtagaggattttgagaggtattatttttttttttgggtattttttaatttttgtgttattaaaaaaaaggaaggtgtgaatgtattattgttattattatattatttatttagtaaatgaatattttttgggttttgtatatttgataaaatgttattatgtgaagttattttttttgtttaattttgatgaaagtttttaaagatagaaatatatatatagatagtatttggtatattgtgaattgtaaaagtgtttaatgatgatagtaattaggataatggaataatatgtgttgagttgatagttggtagtattttaaatatattaagaaagtataaaaaaggattatttaaaaatgaggtgggaatttttaaagtaataatggttttgttaaaagtgaattagaaaaagattgttgtttttgagaaatatatgttttaattaaattaaaaattattttaaattgaattatttgttttaaagtttattttttgttgtttgtgaattttatttatttaattatttttgtatttaataaatatgatttttttttattatttgtgtttttattttattatttttttttttttttttttttgagatggagtttagttttgttttttaggttggaatgtagtggtgttgttttggtttattgtaatttttgttttttaggtttaagtgatttttttgttttagttttttgagtagttggtattataattgtttgttattaagtttagttaatttttttttgtatttttagtagagattatgttggttaggttggtgttgaatttttgattttaagtgatttgtttattttggttttttaaagtgttgggattataggtgtgagttattatgtttagtttattatttttttttttattttatagatatttatatatttttttattgtgtgttaggtattgttttagattttaataattgagtagtaaatgatttttgtttttgggaaatttagaatttagtgaaatatttatttatttttttatttatttatatatttattgggtgtttatgtgttttggggatatagtaatagaaaatataggatttttaggtaaatgaattatattttaaagggtagaagtgaaagtaagggtaaaggttttgagatagttgtgagtatggttagaggttagttagtaaaagggatatgatattatttgtgtttttttttattttgatagggatatataatatttttttaattttttttaaaagattataaaaagttttttttttttaaatagtttgttgttttaaatttttttagtatattatttggggaggtgttattagatttgtgtatttttgttttttattatgtgattttattttggttttttgtaggtttttgtttaaaggaatggtggtgttatttatttaaaataggttttaaaagatatggttaaaatagggtagaaaatttttatgtggtttatttgtaatttttattaatttaatataggttttgtgtttgaggaatttttttaggttttaaatttttggtagttaagttaaaagtgattatgattttgggattataatttttaagagatattgtgtttgtattttttgtgtatgtttaattttggtgattgtataaggtagtgagtttaaggggttgggtttgggtttgagtggtgaattggggtggggttaggggtagggttagggagggggtggtgttgttggtattgtttggaatatgttagtggagtggaagatggtggtggtggtggtggttgttgtagttgggattttagttgggttgaggtggaggagttgttgtttttgattttgttttggttttggtgtgtgtggttgagtgtgtgtgaggttttgtgtgttgggtaggggtggtggtggttattgtgtgttgttttgaggagtgttttagtggtggtgtgattgtggttgaggagagagttggttttgggtttttgtgtttttttgtttttttggttttttgtttttttgggggggtggtggtggtgatgtttttggtttttttgtatgggtggttggtggtttgtgttgtgtttggtggttttttgtagattgattttagggttggtggtggtggtggtggtgattatggattggtgatggttggttgtggttttgggaaggatttttgtaagggtttttttaagaagggtgtgtgttatggggatgatgtgtgttttgtggtttggtattgttttgtggatgtgtttggtgagtttttgatttggtttttttgttttagttttggatttgttttttggggattttttgtgtggggtttttttagttttttttggtggtgaaaggagttagagtgtttatatggagggagtgtttattatgtgttaggtgttgtgttaagtgttttgaggtgtgttttttgtttgaatgatttttattttagagaggaggaaattaaggtgtatagtggttaagttgtgtgtttaaggttataatttgagagtgtgattggtttgtttgagtttagagttatatttttggttttatttggttgtgttagttttgggtgattttgttttttttttgggtgatatttgtaggtttttaattttgttttggttttttttttgtatgttttggggatttttgtttttttgtgtgtttttgatattatagtttggtttaggttgtgggattgttggttgataggtagttgtgagtttttagatagtttggttgtatttttttgttgtttggatggtaattaaatttttattttttttggagtgtggtggtgggggttgttggtttggtgaaaaaatttttatagtgtttttttttaaattgattttgtttatttgtggttatttgggggttggtagagtttttttgatttaaaatagaatggttgagtttatttgtagattgtagttggtaaagttttgaggattggttatagtttttttaggttataggtgttttttgaggtttattttagttatattttttgggggtgggagattatggagagagttggtagaaagggttaaatatagtttataagtagttagaaattttattataatgtatgttttaggagattttgtgtatgttatgggatattgtgttgttaaaattttttgaatgaataaagtaatgtgtttgttttgaaattgaaggatgtgttgttattgaatttgggtttaaatgttattttgatttttttttttaggtgagattaagtttttggttattttaaattttatatgttgaggtagagtttggtattggaataaatgattttgtaatttttttatgatagtaattattttttaatttgattttagaataattgtttagtatttttggttttattatatgtagtgtttgtgaatatgggattggaaaggttgtttttagtttaatttatgaatgattttattatttgggttgaagaaaaagtatttaatgtttaggtaatgttattgatattaatatgagagggagatttagaaaggttttgtagtttgtagattgaaattgtataaatttattttgaagttagttgttagtggttgttttttttgatatatttagaagtgttttatttaatgagtttgtgatttgtgttgtgttttttttttttagatggagtttatttttgttatttaggttggagtgtagtggtgtaattttggtttattgtagtttttgtttttttggtttaagtgatttttttgttttagttttttgagtagttgggattataggtgtttattattatgtttagttaatttttgtatttttagtagagatggggttttattgtgttggttaggttggttttgaatttttgattttgtgattggttttgtgtttgttttggttgtttaaggtgttgggattataagtgtgagtttggtttttgtgttgttttttaaagttgtgtttataatataggataggggataatgagtttttaaggtttattttataaatttgtatgttgggttgtgtgtggtggtttatttttataattttagtattttgggaggttgaggtgggtggattatgaggttaagagtttaagattagattgattaatatggtgaaatttagtttttattaaaaatataaaaattagttgggtgtgatggtgtatgtttatagttttagttatttaataggttgaggtaggagaattttttgaattagggaggtggaggttttagtgagttaagattgtgttattgtattttagattgggtgatagtgtgagattttgttttaaaaaaaaaataaaataaaaaatttgtatgtgatttttgtgaaagatttgtgatttgattgatgatttggggagtatttaaatgtattaaattttatatggaagtttgattttaaaattttggaaggttagattgggtgtggtggtttatgtttgtaattttagtattttgggaggtggaggtgggtggattatttgaggttaggagtttgagattagtttggttaatatggtaaaattttgtttttattaaaaaatataaaaattaggtaggtgtggtggtatatgtttgtagttttagttattagtgaggttgaggtaggagaattgtttgaatttgggagatggaggttgtggtgagttgagattatattattgtattttagtttgggtaatagagtaagattttgttttaaaaaaaatataataaaattttggaaggttatttttttaatggagtgggatatttataagaattggggggattttggttaaatttattttaaaaaagtataaatataattttatgttttgatattttggtggaaatttagtgaattttgatgtttagttttgttatttagtagttttgtgatttgtggttttgggtagagttttttttgagttttttttggtttatttggattaggggataaagggaatggatgatttgatttttagtgattatagtttttgattattatattatatttttttttgttttttttttttttttttttggtgggtggggggtgtgggtatggagttttgtttttgttgtttaggttggagtgtaatggtgttattttggtttattgtaatttttgttttttgggtttaagtgatttttttgttttagttatttgagtagttgggattataggtgtgtgttattatgtttggttaatttttgtatttttagtataaatggggttttattatgttggttaggttgtatttgaatttttaattttaggtgatttattagttttggttttttaaattgttgggattataggtatgaattattgtgtttagtttatattttatttttgttttgaatagatggtattttttgttttgtattttaaatgataggtgttatgggtatttttagtagatttttgttttgtatgtagtattaaattagtggtttttagttttttttgatttataatttttgaggattaggattttgtgtatagagataaaattttgtatgggtttttaggaattttgttgattttatgatttttttgatattatttggaggtttatgtataggaattagattaagaattttagttttgtatttttgaagggaatgttagtagatatagttagata

SEQ ID NO: 1057 - DNA, 6288 bp, Artificial Sequence
  chemically treated genomic DNA (Homo sapiens)
tttgagtaagagtttaaaagaattgatagattgataaaaagttttaagtagtttagaggattgagtattaaaatttagaataatgtaataaaagtatagaagataaagttaaaatgttttatatgatagtagaatatttaggttaagttggaggattggggagaataagtgaagaaggtaagttttggttagataataggtggtttttagtgttaggatgaggatttggaagttaattttttggttagtggataataaatgatggtatttgtgtagttgagttagttgataatgttttaataattttaaaaggttttgaaaaatatggtttttaatttttaagaaaaaaggaatttttgattttaggattttaagttaggaggaaattggataaatttttttatggtttaattgtatagaaaatagattattttggttgttttatttattgagtaattttttttattagagaatgtgttatatatgatttttttatttttaatggaaattttggatttttagttatttttttttgattttttgtttggtgattagaaaaagatgattaaattgggaatttttattttttagtggaaaaaaaaaattatgtatattgtattttatattttttaattgggtgtaaatttgaattttaatattataaaaattagtaaaatttattttaagtataaagttgttaatttttttaagatttattaagaatggtttaattttaaaggttgttaagttaattataagttaagattttttagttgtattaagggtatattttatttggtaaaagaaatatttattggtttttgttaggatgagttttgagttatttaagttttgaattgagaggtttttagaaatttattttatatattaattgtggttttttttatattataaatttttttttatttatttttaaattgtttttttttttaggatatttgtgatataaagattgtgatatatttataggttgattaatatgaggatttaatatttattaaaatatttatatttttgagaatattaaaaattaattattttgttaggttttatttttagtttagttgaattaggaaattttaggagaagtatttggaagtaggtttaataagtgtaaaggtgatttttataattgggaaagtttggaattaagatagggtttttgttttggaggaagtatttttttgtggagaaggatttgtaaatagtttatgaagtgtttagtttttattaagaaaagaaaaatatgggttgatagggttaaggaaatgtttgattgaagaggattaaattttgaaggttagggatgtttttgggtgttggggttttttaattattaaagattgatattataggttaggtagttttttgtttttttagaggattgttttgtgttttatgtttagtatttttggtttttgtttattggatatttttagtattttttttgtaatatatatatatttgataatttaaaatatttatagatattgttaaatattttatagggggtggggtggtggtaatatatttttttgtttgaagttattggaatggaagttaggggaggatggttaagttaggatttgtaaaaaggttaagggatgaaagtatatggttatattagataaagtttgtgatagatgtttgtaggtatatggtaaggaaaatagattaaaatattaagaaatagtaagaggttggattgagggttttttatttgtatgggaaattttattttgtttattatttttagaaataaaaaggaaaatgattttaaagatataggttaaaggttgaaggggtgtagaattattttttgtttttttttttttattttttttaaatattttagaatgagttaaattttttgaattttgtagtatagataataagtaatttagtaagattggatggggatgattgagggttaatttattataggattataggaaattttttagttttaaatttgaatgtatttgtgattatggtaatattttttatttgattaaaagttattaaatgttttgataagtgtttatagttgtttttttgattattgaagtggttttgaaaagagtttttggggttaggtggttgatttattgtgttttttgtatatttttattttgagttggtgtatttggtgattgttttggtgtttttggatatggtgtgtttggttagtttgttgggtagtagtaggtgtatggttgtttggattttgtgggatgtgatggtggagtgtttgttgtagtgtgttaggtgggatgttttttttgtgatgtgtttgaagatgttgttgatgaaggagtttatgatgtttatggttttggatgagatgttggtgttggggtggatttgttttagtattttgtatatgtaaatggagtagttttttttgtggttgtgtttgtgttttttgttgttttttttttgtatttttgtaatagtttttttggagttttttttgggagtaggagtggattttgttggatttggtatttttgtgtgaaaaaagagaaaagagatttaaagaagtaatttgaattattgtaaaatgggttggttatgtgttatttatagagtttgtatgtaaatgaagatttgtaaagtgttgtgtttttattggttaatttataatggtgttgttagagggggtggagtttatgtaaataatagattttagttttgtttttttaatggttattgtaataaaagttttgttattttattagaatggtttattttatattaattagttttaagttaggtgaagtgatagtttttatggtttggggtttttttttggtttttattttttattagatttgtatatggaagaaattttaatgttagttagataagttaatttttttgttttgtttttgtatttttattttatattttgtggaaattttttttttttttttgaaatattattttatttatttttaaaaattgttagatatttatttttgtttgtttaaattattattttggtttggatattgtttgtagtatgtaatgaggaagatgttgagttttaattaagtttatagtttttaaataaattaggaaatgggtttataatttttaagggatttgttttatttttatatttaggattttttatatttagaaattttttatagttttttgtttttatgtaaaattttatttatagaattgggagttggatttttagttttaaattagtgtgaaaatgtttggttggaattataaggattatgtttttgtggttttttttattgttggttaatttatggttgggttttgggttttgtaatgttatttattatgagtgtttttggtttttgattgttgtgtaaggtagatgtatattagatggagagttggtatagttgtttttgatgaaaatggtagtggttttgaaaagagtttttagattgattatttaaaaatatgttttaggtttgttttttgtggatgtggtgggttaattggatgtttttgggtatgatggttatgtgtttggtatggatggtgtataggtttgtgtttttgaatagttttattaggtaggttttgttggttttttgtagtgttattatggttgagttttggaagtgtaggtttgttttaaagttttgtgtgattttgtgtattagttgttggaagggtagtttgtggattagtagttttgtagatttttggtagtgttggattttttgtagagttatggtgttgggttggtagtggtgtggtttttttattttgtttgtggttggtgtgtttttgtgggttgttttggtagttagttgtttttttggggttttgttgttggttgatttgtgggtagtttgtttagtatgggttatgttgttttattgataggagagggtttaggtagttatatttatagatatagtttttttttgattgggtttgaaaaggaaatttttaaatttgtgattttattggttaaaatttaattttttttattggggtggaagattgttttgttaatttttttttttttattattttttttttttttgatttttttttgtaattttattgattatggattgtttttgaagatttttttttaaattagtttaatttttgtaaaagtaatgtataaagtgttttgtattttattttaatagagattttttttttttttgaatttaagtatgtttttttatgagttattagtttgttttaggttatttgttattgtagtttttttattatagttaatatttattttatgtttggtattttgtttagtaagttagatgtattgtatattatgaatgattgaagtttagtaaaaaaatatgtaattgaaggaatgaaaaaattgattttatttatttgattttggaatttagttaaagttattttatgtgggtagtgtgttgatttatattgatttgatattagagtttttgtttttttttagttttttttttttgtgatgtggtttttttttttttaattttatattaatggttaattaggttttgtagatgttaagtttttaaattaaagaaggataatattagaaatttattttttttttataatgtagaatagtttgtaaattagtgtttattagttagattataagtttaagttttaaagtaaattatttattaattgttgatttgttaatattttatttaataaagtattttataatgtttaaaagtttagttttttttttgttttttatgaagagagtaaagatgttttgtttttttaattttatgtgttttgaagtatgtattgtttagaatagtaaatattatagtggttatgtagaagtaattgatatttaaaagttgtagtagttaatataaaatttttaattatatttttattttattaaaaaaattattataaattataaaaatttaaatttgagaaaagtaggtttgaaatgtttaaaatttattttgatggtgttattatgaattatttttttattgaagttaaagtaaagtaaaagtgattttaaggggattttttgaatattaaatataaagtagaaatttgtgagtttaattaatatttttaagagttttttatgggtagaagtattttttttttgagagatttaaaatgtataaaagtgtaattgatgtgaataaatgttatttttttttgtggtagttttgtaataatgttttatagatagtaggtattatttagtgtttaaagtttttttatatatattttattatttaatttttattttgtgaaatagatgttattttttttattttatagataagaaaattgagttttagagaaattatggtttgttttgggtaagtaataaagtttgtgtaatattttaaagtaaaagaatgaaattgtaatgatgaaattttttattttattaggtttagaggatattttttttttttttttttatttgagatggagttttattttgttatttaggttggagtgtagtggtaggatttttgtttattgtagtttttgttttttgtgtttaagtaatttttttgttttagttttttgagtagttgggattataggtgtaagttattatttttagttaatttatttatttatttgtatttttagtagagatatggttttattatattggttaggttggttttgaatttttgattttaggtgatttattttttttggttttttaaagtgtttgggttgtaggtatgagttttatgtatttagttaatatagtttaaagtataaaagtgtttttttattaagtaattatattatttagtattttttaaatatttatatttaattatttttattagaagggaaaattattttatggaatttggatgatagtttaaagtagtttatttaagtattatatttttttgtaatatattttttttatgatgtatgtagttttgattataatgtaggatgtgtttatttaaataagaaaatggtatttaattagattttaatggttataggtattattttttagaataaaataattagatgtatagttgttttaaaagttatttttaataatagaatttagattaattgttagtttaattttatttagtttttatattggatattagagtgatatttttgtgaaaggttttaatttattattatattagaagtaattttatggtgtaaaagaagttttgtttttttttagttgtaataaagatggaatattttttttaaaatttttgaagtgttttttagtagaaattataaggttgtgtagtttgaata

SEQ ID NO: 1058 - DNA, 6288 bp, Artificial Sequence
  chemically treated genomic DNA (Homo sapiens)
tatttaagttgtatagttttataatttttgttgaaggatattttaaaaattttaggaggaatattttgtttttgttataattgaagaaaagtagagttttttttgtattataaagttgtttttgatatagtggtggattgagattttttatagaaatgttattttagtgtttaatgtggggattaggtgaaattgaattaataattgatttgaattttgttattaaagatgatttttaaggtaattatatatttgattgttttattttgagaaatgatatttatagttattaaagtttgattgaatgttatttttttatttaaatgaatatattttatattatggttaagattgtatatattatagagaaagtatattgtaaagaaatgtgatgtttgggtgggttgttttgggttattatttagattttatggggtagtttttttttttaatgggaatagttgggtgtagatgtttgagaaatattagatgatgtgattgtttgatgggaaaatgtttttgtgttttaaattgtgttggttgggtgtgtggggtttatgtttgtaatttaagtattttgggaggttgaggagggtggattatttgaggttaggagtttgagattagtttgattaatatggtgaaattgtgtttttattaaaaatataaataaataaataaattagttgggggtggtggtttgtgtttatagttttagttgtttaggaggttgagataggagaattgtttgaatataggaggtagaggttgtagtgagtagagattttattattgtattttagtttgggtgatagagtgagattttattttaaatgaaaaaaaaaaaaaaaggtattttttaagtttaatgaaatagaaagttttattattatagttttatttttttgttttagaatattatataggttttgttatttatttaggataagttataatttttttgagatttagtttttttatttgtaaagtgagaagagtaatatttattttatagagtagggattaaatgataaagtgtatgtagaagaattttaaatattgagtagtgtttgttgtttgtaaggtattattataaaattattatagagagggataatatttgtttatattagttatatttttgtatattttagattttttgagaggaggatgtttttgtttatgagagatttttgaagatattaattaagtttatagatttttattttgtgtttagtgtttaggaagtttttttgaaattatttttattttattttgattttagtaggaagatagtttataatgatattattaaagtaagttttaagtgttttgggtttgttttttttaggtttgagtttttatagtttgtaatgatttttttagtaaaataaggatatgattaaaagttttatattaattattataatttttaagtattagttgtttttatataattattatgatatttattgttttgaataatatatattttaaagtatatgaaattgaaaaagtaaagtatttttattttttttatagagaatagaaaaaaaattaaatttttaagtattataaaatattttattgaataaaatgttagtaagttagtaattgatgaataatttgttttgaaatttgaatttgtaatttggttaataagtattaatttataaattattttatattgtaaaggagaaatgaatttttggtgttgtttttttttgatttagaagtttaatatttgtaggatttaattggttattgatgtgaggttgaggaagaaggaattatattgtagggagaaaagattaaaggaaggtagaggttttaatattaggttaatataggttagtatattatttatatgaaatggttttggttgggttttaaggttaagtaaataagattaatttttttatttttttaattatatatttttttgttaagttttggttatttatggtatataatgtatttaatttgttgagtaaaatgttagatatgaaataaatgttagttatggtagaagagttatagtaataggtaatttgaaataggttgatagtttatagaagggtatgtttgaatttggggaaaaaaaaaatttttgttaaaatgggatgtaaaatattttatatattgtttttataaaagttagattaatttaaaggaaagtttttaaaaataatttgtgattgataaaattatagaaaaaaattaggaaagggggaaataataagggaagaaagattagtagaataattttttgttttagtaaagaggattgaattttaattaatgagattataagtttgaaaattttttttttaggtttaattaagaggagattatgtttataaatatgattgtttagatttttttttattaatgagatagtatggtttgtattaagtagattgtttgtaagttgattggtggtaaggttttgaggaagtagttggttattaaagtggtttgtaagagtgtgttggttatgggtggggtgaagaagttgtattgttattggtttggtattgtggttttgtgggagatttggtgttattagaagtttatggagttgttgatttgtaagttgtttttttagtggttggtatgtgagattgtgtaggattttaagatggatttgtgtttttagagtttggttgtgatggtgttgtaggaggttagtgaggtttatttggtggggttgtttgaagatatgaatttgtgtgttatttatgttaagtgtgtgattattatgtttaaggatatttagttggtttgttgtatttgtggggagtgggtttaaggtatatttttaagtggttgatttaaaggttttttttagagttattgttgtttttattaagagtagttgtattggttttttatttgatgtgtgtttgttttgtgtagtggttaggggttaggggtatttgtggtgggtgatgttatagaatttaaagtttagttgtgagttggttggtagtagagaaagttgtagaggtatggtttttgtggttttggttgagtgtttttatgttggtttaaggttagaggtttggtttttaattttgtgggtaaagttttgtatgggggtaagagattatggggagtttttagatgtggaagattttgagtgtaagggtggggtgagttttttaaaaattataaatttgttttttggtttatttaggaattataagtttaattaaagtttagtattttttttattgtatattataggtggtgtttaagttagaatagtaatttaagtgggtgggagtaaatatttggtgatttttaaaaatgggtgaggtagtattttaaggaagagaaaaaaatttttataaagtatagaataaaaatgtaaaaatgaggtaagagagttaatttgtttagttggtgttaagattttttttgtatgtaagtttaatggaaagtgaaaattaagaaaaaattttaagttgtagaaattattgttttatttagtttaaaattggttagtgtgaaatggattattttgataggataataagatttttgttatagtgattattaaggaagtaagattagaatttattatttatatagattttattttttttgatgatattgttgtaagttaattaatgaaagtgtagtattttgtgagtttttatttgtatatgggttttataagtagtgtataattagtttgttttgtggtagtttggattatttttttaagttttttttttttttttttgtgtaaaaatgttggatttagtgaaatttgtttttgtttttaagaagggttttaaaaaggttgttatgaaagtgtagaagaaggatggtaagaagtgtaagtgtagttgtaaggagagttattttgtttatgtgtataaggtgttgaagtaggtttattttgatattggtattttgtttaaggttatgggtattatgaatttttttgttaatgatatttttgagtgtattgtgggagaggtgttttgtttggtgtattataataagtgttttattattatattttgtgagatttagatggttgtgtgtttgttgttgtttggtgagttggttaagtatgttgtgtttgagggtattaaggtggttattaagtatattagtttgaagtaagagtgtgtaagggatgtaatagattaattatttaattttaaaggttttttttagagttattttagtaattgagaaagtagttgtaaatatttgttagagtgtttgatagtttttggttaggtagggagtgttattatggttatggatgtatttgggtttaggattaaggagttttttgtagttttgtaatgagttggtttttagttatttttgtttagttttattgagttgtttgttatttgtgttatgagatttgaaaggtttgatttgttttgggatatttgggagggatggagggaaggaggtggggggtggttttatatttttttggtttttaatttgtatttttaaagttgtttttttttttgtttttgaaagtaatgaatgagatgagattttttatatagatgagaaatttttggtttgattttttattattttttagtgttttaatttgttttttttattatatatttataggtgtttgttataaattttgtttaatatagttatgtgtttttgttttttagtttttttgtaagttttgatttagttatttttttttaatttttattttagtgattttaaatagggagatatattgttattattttattttttgtggagtatttggtaatatttgtagatgttttgggttgttaggtgtgtgtgtgttgtgggggaggtgttagaagtatttaatgggtagaggttaggagtgttaagtataaggtataggatagttttttggggggataaagagttatttggtttgtaatgttgatttttggtgattgagagattttagtgtttaaagatatttttaatttttaggatttaattttttttagttaaatgtttttttaattttattagtttatgtttttttttttttggtgaaagttgagtattttataggttgtttataggtttttttttataggaaaatattttttttaggataagaattttgttttggttttaaatttttttaattataagagttatttttgtgtttgttaaatttgtttttaggtgttttttttgaggttttttgatttagttagattggaggtgggatttgatgaggtggttggtttttagtgtttttaggagtgtggatgttttaataggtgttgggtttttatgttaattgatttgtgggtgtgttatagtttttgtgttatagatgttttgagaaaggaaataatttgaggatgagtggaggggaatttgtggtgtagagaaggttatagttaatatgtggggtgaatttttgaagattttttagtttaaaatttgaataatttaagatttattttgataaaagttagtggatgttttttttgttaaataaaatatatttttggtgtaattggaaaattttagtttataattaatttgatagtttttgaaattaagttatttttgataaattttgggggaattaataattttgtgtttaaaatgaattttattaatttttatgatgttgaaatttaaatttatatttaattaaaagatataaaatgtggtatatatgattttttttttttattagaaaataaagatttttagtttagttatttttttttgattattagataagaggttagggaaagataattgagaatttaaaatttttgttgaaagtaaagaaattatatatagtatattttttggtaggaaaggttatttagtaagtgagatggttgaggtggtttattttttatatagttgggttataagagaatttatttaatttttttttagtttagggttttgaagttaggagtttttttttttttaaggattagggattatgttttttagggttttttgaagttgttaaagtattgttaattggtttaattatataaatgttattatttattatttattgattaaaagattaatttttaaatttttattttgatattaaaggttatttattatttagttaaaatttattttttttatttgttttttttagttttttagtttagtttaaatgttttattgttatgtaaagtattttaattttgttttttgtgtttttgttatattgttttgagttttagtatttagttttttggattatttgaagttttttattagtttgttagtttttttaaatttttgtttaaa

SEQ ID NO: 1059 - DNA, 6502 bp, Artificial Sequence
  chemically treated genomic DNA (Homo sapiens)
ttaaaataataaaattttattatattttgtgtatatttttagttattataagattattttttttgtgtgtatgtataattaaattgatttttttttatttaatatattaaagtatatttttttatgttaatatatatttatatttattgttatttttagaagttatatataattttattttatggatgtattgaaatttatttataaaattttttatttgttttttttttaatatattgttattggaaatagtgttgagaaaaatgaattgtatgtatttttaattattttttgaaaatattttagtataatggaattaatgggtaaaggatatatatttttttaagagtgatgtttattattaaattgtttatttaaaaagttaatagtaatttaaattttaagtagtggtgtaagtattattgattttttagattattagtagatttggaaaaagtattttgattaattttaaattatagtttttatttttttaaaaaaaattttttgtaaaaggaagatatattttttattgtaaataataaatgtttatatttatgtatataatgtgaatattttgtaagtatgttgttttttattttgttaatttttttttgatgtaaggggagttttaatttttgttttttaaattaatttgtagaatgtatttataggaaggtttttgttaatataaaaatgtatttgtataaataggtatttgtgtttttttttggtattttttaattttgtatatttaagtttttatgtatattttattaataatttatttttgtaatataaaaatttagttagtttttttgagtttatagatatgttatttataaataatttatttttttatatatatatgaaatgttattaggattaggttttaaaattttatatattttttagtatgtgtgtattttttattttgttttatatatttatttgtttttttattttttagtaaatgaaatttaatattatattttgatatatagaagggtaagtttttattttgttataaaaatttttttaatgttattataagagtaaaaggtagtatatgtaatttagaaattttaaaattttgatgtttttatttggtttatttaaaatgaatagagtttatattttgagaaaaatgagtttttttatatgtatatgtatgttgattgtggtattatttataattataaagatttggaattaatttaaatgtttataatgatagattggattaagaaaatgtggtatatatatattatggaatattatgtagttataaaaaaggatgagtttatgttttttgtagggatatggatgaagttggaaattattatttttagtaaattattataagattagaaaattaaatattatatgtttttatttgtaagtgggagttgaataatgagaatatatggatatagggaggggaatattatatattagggtttgttggggggagggggtggggggttaggggagggataatattaggagaaatatttaatgtaggtgatgggttgaggggtgtagtaaattattatggtatgtgtatatttatgtaataaaattgtatgttttgtgtatgtaatttagaatttaaagtataatttaaaaaaaaaaagaagaaaaaaagaaagaaaaatgagtttttttatttaagaatagggaattatttttttattttaaaagatttttttgaggttatttatgaaataatttattatttaggtgtaggtggatataaaagggatattagattttatttaaagaatttttagtttagaagttaatataatatagaaattattttttttatgatgtttgtttttataatatatataatattgtttaaaatgtgtataataaaaataaaaagttatgttttttaattttttttaaagtattaaaatttttagtaaagtaatgggaattatgagaggattggattagttaaagttttgtttgttgtgttgtttatattgatgattttgaggttgttatattggttgttgtgggttgtagagggaataaagtttagtgtttttggggataggggtgagttgagagtaggaaagggggtttttttttgatttgttttttttttttttttgttgggttttagtttttattatttgttttttttgtttttgttatttatgttattttttggtagagaaaggatttgttgtattgtttttgtttggtgttggttggtagttttgtggagtttgttgaattttttgtttgggttgtggtgtttgggttgggaggaggtgtggtttttatttttatttttggtgtttgtgtttatttttttggggttgttgattgagttttagggtagtttgttttttttttttttgaagtttgaggttttttttatggttttgtttattggttttggagatttgttggattttttgttgtttttggaattttatatgaggaagtaaattgtgtttgttatagtttttaattaggaaattttgtgatttttagttttttagaagagaaatggagatgtgttaagtaaagttgttatatggattgtgtatgtgtttttggtgtttttgtgtgtgatataaatttggttttgagggagttttgtgtgtttagttttagagttgtaggtgagagtgtttgtttgtatgagtgagtatatgggtgtttttgagtttgtgggtgttatagagaggagattgggagttgtttgtttataggtattttgggattttgaaagaaaaggttgtgttgagagagtttttttagttagaggtttgggaatgggggagaagggagtgtttggaattttgattttagaattgagtttttgaagtgggaaatagtggtttttttatatgtttaagggttaggtaggtgtatttattttgttttgtatggtttaggtgtgagttggtgggtagaggggtggttttgggtttagttgagaaggtttttgggattgataggggttggggttggggagttttgtttttttgtgtggtttagtgttgggaggggtaagggatgagggtaggggttttattgttgggttttgattttttaggttatttagattttgtttatgtgggtatttaggggttaggtgtttttagagggaattaagttgggtagggttattgtttttttttgtagaggaggaagttgaggtttatgaggtaaatagtgggttgggagtgggtttggtagattttaattttagtttatggagattaattattgagggagtattataaatgttttttaatggttggattttttagtttttatgtaatggggtttatattgattttggggttttattgggagagagtaggaggtggtttgaggttgggtatgggtggttatgggggtatggattggttgatttttgtgtattgattatattttttattttttaggtgttatgaagattggatatgggtttattagggttatgggtatgatgttagttaaggaatttgtggtttgtttttgttaagagattagtattttggtttgagtatttttagttttttattgtttttaatttggttgtatttagttgttatgtttttatttttttgtgtggttagtattttttaggattttattttgggttatttaaaggttgaggatattgttggttagtaggaaatttatggtgtatttaggaagatttttaagaggtggtggagtagggggtgttatatttagatagttgtgtgtaattgtgtagttgtgggttgttgtgggtgttggttggtagtgtattttgggtatattggattgtgttattgtatgtaggttgtggttggagggggaattgttggttgttaaggtttatgtgtttggaaattagtagggttgttgtaggaggagggttgtagaatgttttagtttagatttgatttagggttttagagggtatagggtataaggttgtggatatagatagttttattgtgtaggaagagtataaattagttggagggtatgtatgtgggttgttgttagattttgtttttttttgaggtagggaaggatgtgtttttattttatggatgagtaaattgaggtagagtgttggagtgattttttttagtaatgatggtagatttagttttagggtttagattttaggatttttttttttaaatattatgatgtattatgggttttttttttatagaaaattagaaatttagaaatggaaagggaataatgaaatttatttatttttttattgtttatatttttttttggtttttttgtgtgtgtatataaaatatattttagaaaattgagtttgtgttgtggatgttatttatattttattttttatatttaatagattatgaaaattttttttgttgttaattatattttttggtagttttatggtttattttatgtatgtgttgttatttttttggagagttttagatttttgtttttagttgtaatatattaggagtgatattttgtttttatgatgttttttttttaagatggagatagatatagtgtttttggattagagagtattgttatttgtaggatttttgattttaggagttgtttttttaattatttggttattttttattttttatttagttttgatgtttattgtaaattgtttgttaatttaatgggtgaatttttagttgttttgatgagtatttttttgattgttggaaggtgataggaaggagttttagtaatattaaaattattgagattggggatttgggggtattattaatgttagttttttttttattaagtgtgtgtatatatatatatatatatatatatatatatatttttattttgttttttaggtgtttaatttgtatggttttggtttgttagtgaggaagaattttttttttttttttatgtgatttgaggttattatatttgtatttggaaattgttaaaattgaggttttgttttttttttttagtgagaatttatgagtatttttaatatttttatgtggatatagatatatgttatttgtagtttttgtgttattttgttttgtttatagatatatttatgggtttagagattagtaaggttatattgttaatttaaatttttgtggaaaaggaaattgatgtaggatttgtttagggttagttttgttgttgagtatttgtgtaattttaattttgttatttgtaaagtgtttttttgatagggtaatggagagattgaggggaatgtagggttgatggttgtatattgggaagtgtagttgtgggttttggggatggtatggtgtgggggtttttttaaagggatataggtttttgtagttttgtgggaaggaagttatttaggttaggtgtatagggataggatttattttggtttaattatttgggtagttgaggggttgtggggaaggggttagtttattttgagtaattttttttatagggaagttttatggtatgtattagttggttatattgttaatgagttggatgtggaggatgtattgtattttttggtggttaatattttggtggttatttggatgaggtttataagtttttgttggtagtttttttttgaggatttagatggttttgtgttggttttgttggttttgttgtggttggggagaggttgtttttatgatgttaatttaggtgggttgtagagggtaggtagtagtgggatttttttttgaggagggtataggttttttgtggtttttgttttttattttataatttgggttttggagtaagtaaattttgtttagttttagttttgttatttgttataggtttttatttttttgatttttagtttttttatttgtgttttggttttttaggttgttatggaaattagttgaagtaggtattttagggtttagtaggttttttgtatatggtaagtgttttgtatttgtttttgttgtggttttgatgatattggtgaaggtttttgtttgtgtgtttttgtttttatgtttttttatattatattgttttttaggtgaaaagaggttatgtattttatatgttttatattataagaaaatttagaagaattttttttataaaaggtttaatttaattgtatgaaaagtatttaagaagatagtataaattattgtgatagtataattaaaattggaaagaagtttttatattaagagttatttttatatattataatgttatagatagtgatattgtttttttgtataaaaagtatgaggtaaaagtttatgtagagtttttgatttttttgtttttaagttagaatatttttagtttttttgtttgtgatgtgttgatttttagaaatttattttgattttgtgtattttgtattttttaagaagaaagtgttaattgaaaattgtatggttattagtgagttttaaataataatagatgagaatttttttgatatgtttattaaaatagaattagagtatgtttttattatttt

SEQ ID NO: 1060 - DNA, 6502 bp, Artificial Sequence
  chemically treated genomic DNA (Homo sapiens)
aagatagtgagaatatattttaattttattttaataggtatattaggagaatttttatttgttattatttgaaatttattgatggttatataatttttaattggtattttttttttgaagagtataaagtgtataggattagaatgagtttttgagagttggtatattatgagtgaaggagttggagatgttttagtttagaggtgggaaagttaagggttttgtatgagtttttgttttatattttttgtatagagaaatagtattattatttatagtattgtgatatataggaataatttttaatgtgaggatttttttttagttttaattatattgttataataatttatattgtttttttagatgttttttatataattgaattgggttttttgtaaaaagaatttttttgagtttttttgtaatgtagaatatgtaaaatatatggtttttttttatttgaaaagtagtatggtatggaagggtatagggataaaaatatataaataaaaatttttattgatattattggaattatagtaaaaataaatataaagtatttattgtatgtaggaaatttgttgggttttggggtatttgttttggttaatttttatgataatttaaaagattaggatatagatgaggagattgaaggttaaagaggtgagggtttgtggtaggtggtagaattagggttgaataaggtttgtttgttttaaagtttaggttgtggggtggagagtaagggttatggaaggtttgtgttttttttagagaagagttttgttgttatttgttttttgtagtttatttgggttggtattgtagaagtagtttttttttagttgtagtaaggttagtagggttagtatggggttatttgagtttttaggagagggttattagtagggatttgtgggttttatttaggtggttattagggtgttggttattagaaggtgtgatatgttttttatatttaatttattggtagtgtggttagttggtgtatgttgtggggtttttttgtggggagagttgtttaggatgggttggttttttttttataattttttaattatttagatgattgggttaaggtaaattttgtttttatgtatttggtttgggtagttttttttttataggattgtagagatttgtgtttttttggagggatttttatgttatgttatttttagaatttatagttgtattttttggtgtgtagttattgattttatattttttttaatttttttattgttttgttagggaggtattttatagatgatagaattgaggttatatagatgtttaatagtagggttgattttgggtagattttgtattagtttttttttttataaaaatttggattagtaatatggttttgttggtttttggatttatgggtgtgtttgtaggtagaataaggtaatataggggttataagtggtatgtgtttgtgtttatgtgggaatgttgggaatgtttatgaatttttattgggaaaaggagatagagttttaattttaataatttttagatataaatataatggttttaaattatataaaagaaagaagaaagtttttttttattagtaaattaaagttatataaattaagtatttgggaggtagaataagagtgtgtgtgtgtgtgtgtgtgtgtgtgtgtgtgtgtgtatttggtggggagggggttgatattaatgatgtttttaaatttttagttttagtggttttaatgttgttaaaatttttttttgttattttttagtagttagaggagtatttattagaatagttgagggtttatttgttaggttggtaaataatttgtagtgagtattagagttgggtggaggatgagaggtgattagatggttagggggatagtttttgaagttaaggattttataggtggtagtgttttttgatttaggagtgttatatttgtttttattttaaggagaaaatattgtggagataggatgttatttttgatgtgttataattaagagtaaaaatttaggattttttgaaggaataatagtatgtgtataggatgggttatggggttgttaggaaatataattagtaataaaggggatttttatgatttattgagtataaaaggtaggatataaatggtatttatagtataaatttaattttttgagatatattttatatgtatatgtaaaaaaattagaaggaaatgtgagtagtgggagaatgggtaagttttattgttttttttttatttttgagtttttaattttttgtggagagaaagtttatgatatattatggtatttgagagggaggattttaaaatttaagttttggagttaaatttgttattgttgttgggggaaattattttagtattttgttttagtttgtttatttataaaatagaaatatatttttttttattttaaaggagaatagaatttaatagtagtttatatgtatgttttttggttggtttatgttttttttgtgtagtagggttgtttatgtttatagttttatgttttatgttttttaaaattttgagttaggtttgagttggagtattttgtagttttttttttgtagtagttttgttggtttttaggtatataggttttggtggttagtagttttttttttggttatagtttgtatgtggtgatatagtttagtgtgtttagaatgtattgttggttagtatttgtagtagtttgtagttgtgtaattatatatagttgtttgggtgtggtgttttttgttttattattttttggaagtttttttggatgtattatgaattttttgttggttagtaatgtttttggtttttgggtgatttaagatgaagttttggagggtgttgattatataaggaggtaggggtatggtagttgaatgtagttaggttgaaggtgatgggaggttgggagtgtttaggttgagatgttggttttttggtagaggtaggttgtgagttttttggttgatattatgtttatggttttgataggtttatgtttagtttttatgatatttgggggatggagagtgtggttaatgtataggggttagttagtttatgtttttgtggttatttatgtttagttttaagttattttttgtttttttttagtgagattttagggttagtgtagattttattgtatgaaaattgggggatttagttgttaaggggtgtttgtagtgtttttttagtagttggtttttatgggttgggattggggtttattaggtttatttttagtttattgtttattttgtgggttttagtttttttttttgtagaaggggatggtgattttgtttagtttagttttttttaagaatatttgatttttgagtgtttatatgggtagggtttgagtggtttgaggggttagagtttagtgataggatttttgtttttattttttattttttttagtattgggttatgtaggaaggtagaattttttaattttaatttttgttaattttgggagtttttttagttggatttagggttatttttttgtttattggtttatatttgggttatgtaaggtagggtggatgtatttgtttggtttttgagtgtgtgggggagttattgttttttattttggaggtttagttttgaggttgggattttgggtattttttttttttttatttttaaatttttgattggaagaatttttttggtatagtttttttttttggggttttaaagtgtttgtgagtaggtagtttttgattttttttttgtgatatttatagatttaaaaatatttatatgtttatttatgtagataggtgtttttgtttatggttttgaggttgagtatatggagtttttttggggttaaatttgtgttatgtgtagggatattggaggtgtgtgtatagtttgtgtaatggttttgtttggtgtgtttttgttttttttttgaggggttgagagttgtggagttttttggttggaggttgtggtggatgtgatttgtttttttatatagggttttggaggtggtggaaagtttagtgggtttttgaagttggtagatggagttatgaagaagattttgggttttaggagggggaagggtgagttgttttggggtttggttagtagttttgggaaggtgggtgtgggtgttgggagtgagagtgaggattatgtttttttttagtttaggtgttatgatttggataaggggtttgataggttttgtagagttgttggttgatattggatagagatgatgtggtggattttttttttgttgaagagtggtgtggatgatagagatgagaagaataggtaataggaattggagtttggtagaggagggaggagggtgggttggggagaggtttttttttttgtttttggtttatttttgtttttgagggtgttgggttttgttttttttgtagtttgtagtagttggtgtggtaattttaaggttattaatatgagtagtgtgataaataaaattttagttggtttgatttttttataatttttgttattttattgaaagttttagtgttttaaaaaaaattaagaaatatagttttttatttttattgtatatattttaaataatgttatatatgttatggaaataagtattatgagaaaaataatttttatattatattaatttttgggttaaaaattttttggataaaatttaatattttttttatatttatttatatttgagtaataagttattttatgaatgattttagaaggattttttgaagtgagaggatggttttttgtttttgaataggaagatttattttttttttttttttttttttttttttttttaaattatattttaagttttggattatatgtgtaggatgtgtagttttgttatataggtatatatgtgttgtggtggtttgttgtattttttaatttgttatttatattaggtattttttttaatgttattttttttttggttttttattttttttttttgataggttttggtgtgtgatgtttttttttttgtgtttatgtgtttttattgtttaatttttatttatgagtgagaatatgtggtgtttggttttttgattttgtgatagtttgttgagaatgatggtttttagttttatttatgtttttgtaaaggatatgaatttatttttttttatggttgtatagtattttgtggtgtatatgtgttatatttttttaatttagtttattattatggatatttgggttggttttaagtttttgtaattgtgaataatgttgtagttaatatatgtgtgtatgtgggaagatttattttttttgagatgtgaattttatttattttagataaattaaataaaagtattaaggttttaagatttttaggttatgtatgttattttttatttttatgatgatattaagaaaatttttataatagagtaaagatttgtttttttatatattaaagtgtgatattaggttttatttattaaaagatgagaagatagataaatgtgtggaatagaataaaaaatgtatatatattgaaaaatgtgtaagattttagaatttgattttgatgatattttatatgtgtatggaaagatgagttatttgtaaatgatatgtttgtgaatttgagaaaattagttagatttttatgttataaaaataagttattgatagaatatgtgtaaaaatttaaatatataaaattagaaaatgttagaagaaaatatgaatgtttatttatatagatatatttttatgttgataaagatttttttatgaatgtattttgtaggttgatttagaaaataaaaattaaaattttttttatattagaaaaaagttaataaaataaaagataatatatttgtaaaatatttatattatatatataaatatagatatttattatttgtaatgaaaaatgtgttttttttttatagagaattttttttaaagaaataagaattataatttaaaattggttaaagtattttttttaaatttattagtgatttggaaaattagtagtatttatattattgtttaaagtttaagttgttgttaattttttaaataaataatttggtggtgaatattatttttaaaaaggtatgtattttttatttattgattttattatattaaaatatttttagaaaataattagagatgtatataatttgttttttttagtattgtttttaatagtaatgtattaaggagagggtaaataaaggattttataaataaattttagtgtatttataggatgaaattatatgtaatttttgaaggtggtaatagatatggatgtatgttgatatgggaagatgtattttggtatattaagtgagaaaaaattgatttgattatatatatatatagagggaatggttttgtggtagttgaaagtatatataaaatgtgataaaattttgttattttgg

SEQ ID NO: 1061 - DNA, 6173 bp, Artificial Sequence
  chemically treated genomic DNA (Homo sapiens)
agtggagatgggttttattatgttggttaggttggttttgaatatttgattttaagtgatttatttattttagttttttaaagtgttgggattaaaggtgtgagttattgtatttggttttttgattttttttttttgtttttaaatagagaagggggttttattatgttgtttaggttagttttgagttttttgttataagtgatttttttgtttggattttttatatgttagtttagatattttttataattttgtttaagtttagttatatggtttttttagttttaaggaggaatgaaatattatttggaaataatttgtttgatgtttatattattgaatataatattataattttaatttagttttttaaattttttttggaattgttttgattgattagggttgtgttttattaaattttgtatatttgttattatttgatagttatttttattatttttagttgtgtgtaaaattgttttaaggaagtttagggtttagagatttatgtttgtgtagatatgtagaagaattttttttaatattttaaaattattaattagtggatgtttttgggatttaatttttatttaattaagggtgaaagtttagtttgtatattttttgagttttttatgttgttgaatttaaattgaagttttttttgtttttattttttttttagtattaatataaatatagtattttattattttttaagtggtattttatttatttttttattttgagggtgattgtgtggtaggtttagttgtagggggtttatttagtaagttgttttaaaattttttttagttttaggtgtgaattggttatgttttttgttagtaagggttgatggatttaatttttttatttatttaattatttatttagtaagttattattgaatgttaaggttgtattatgatttttaagggttttaagtttttttgtttttgtggtttttttttgtttgaaaatatatttaaaattatattttatgattgtattgttattaatgatgattataatttagattggatttattataatatagtaaatatattatttttttttgaaaaaatttttttgagatggggttttattgtgttatttagtttggagtgtagtggtttgattattgtttattgtagttttaatttttttaggattaggtgatttttttattttagttttttaagtagttgggattataggtatatgttattaagtttgattaatttttgtatttttagtatagttagggttttgttatgttggttagattggttttgaatttttggttttaagtgatttatttattttagtttttataaagtgttggaattataggtatgagttattgtgtttagttatttgttttgattttattttatttattttttttatatatgtatttttgagatggagtttttttttgttgtttaggttggagtgtagtggtatgattttggtttattgtaatttttgttttttaggtttaagtgatttttttgttttagttttttaagtagttgggattataggtgtatgttattaggttaggttaatttttgtatttttagtagagatggggttttgttatattggttaggttggttttgaatttttgattttaggtgatttgtttgttttggttttttaaagttaggattatagatgtgagttattgtttttggtttttttgtttttttttttttttttttttttttttttttgagatggagttttgttttgttgtttaggttggagtatttttagtatgtgaggtggttatgaatgataaggagaaaaaataaggtgaaggggaatggggagtgttggtaatttagatagaatgtgtatgaaaggttttaatgggaaattttaatttgaataaaaatgtataaaatgtgaggaaagtttaggaatatattagttgtatattttgttgtagagaagttaaggatgaggaataggtattaagaataaattttagtgtaaggttttttttaagtgtggtttttagggttatgtatttttattgtttataggtgaggttgtgggtttgtaaataagtgattgttgttgtaatttttattttgttttttggtattaaatttaggttgatttatttattgttattttttttttatttttggttttttttttttttttttttttttttttgagatagagttttgttttgtagtttaggttggagaatagtggtgtgattttggtttattgtaatttttgttttttgggtttaagagatttttttgttttagttttttgagtagttgggattataggtgtgtgttattttgtttggttaagtttttgtatttttagtagagatgggtggggggaggggggagggggttattatgttggttaggttatttttgaaattgtgattttgtgatttgtttgttttggttttttaaagtgttaggattataggtgtgagttattatttttggttttgggtgttggttttttttatttttgagtgaatagtagagggggttgttgggtgagggttagaagagttggggaggtatgagggtgtttagtgttgtttttatttaagatggtggttagagttttgtgtttggttgtgtggggtggtgtgtgagtgtttagtttataggttttgggattgtgtttgggggtgggtttatagtgggaaggggatgtgtgttttgtggtttggtttttagttattgtttttgtagtggtggttaatattattgttattgttattttttttagattgtggatgggaggatggagttgatggttgttgttattgatggtggggagaggttgggggttttagtgggtttaggtttgttggttttttagtgttgggtggagttgtgttggagaaagttgtttatgaatttggaatagtgtattaattggattatgggtttttataggtttgggagtggtgtgggtaagagttttgatttttttttagttttttgtttattattttgaatttttagggttattttttttttttttatttttatttttttgatttttttgattaagttttgttttttgattttttttttgttttgtttttttggtgatattttaagtttttatttttgaattttaggatgtttttagttgttttttttaatttttttggggttttgttgtgagattttttttattttgtttgtagagtttttattttttttttttagttatgttgaatagttttttttttttttagttattttttgttttttttgaagggtgtatgttgtatttttagattgttatgtttattgttttttttaggaagatggtttttttttttaaggttttaagtgtttttttttatagtgttttttttagtgtttatttttttttgttttttgttgtgtaatttttgtttgtttatattagtttgtttttattgaattgtttgttagtttattttatgtgtattagggatttttgtgtttatattttagtgtttgtgtttagtgttgttaatattgttatttatgggttggttagaaaaggtgggaaaagtgagagtgagtattttttagagatttagtaagtgtgaagtgtatatttgagagttttttttttttatgaggggatattgttgtgattgatgtttggagttgtatttttaaggagagtgtttttttttttttttaaatatatgtttaatgattttttttaaaaaaaatttattttatgtgagtataattgagtaattagtgtgttttagtgttatttaagtttttagtgttttttttagtaattggtttttagttattggttgtaagttttttatatttttgtgatttttgttttgtaaggttttaggtgtatagttttgaatttttaggtagtttaaatgagaggtaagaaaattattttaaatttttttagaataatagaagaaatatttttttattgggttatttatttttaaagtattatttatgattttatttgaggtattttttatattttgtttttttgttttgaaaattttatgtttttaaaggttgttttattttttgagatagggtttttttttgtaggttaggttggagtgtagtggtatgattatagtttattgtagttttaaatttttgggtttaagtaattttgttattttagtttttggagtagttaggattataggtgtatattattatgtttggttaatttaaaaaaaaattgtgtgtgtggagatgggggggttttattatgttttttaagttggtttggaatttttgggtttaagtgatttattagttttggtttttaaaagtgttgggtttataggattataggtgtgagttattgtgtttggttttttttttaaaataaaaataaaaataaaattttagagtagtgttttaaaattgttgaagtgtttattaatggttgtttgattatataaatagtagttttgggatatgttatattttatgtttatagggtattggatttagaaatttaattttaaaatatagattttaaaaggttttattgattttatatttttaattaaataagttaaggtaggtaatgtaattatatatttgggatatattatttataaaaagttggtttttttagtttgttttatttttgaatattttttttagtttgtttattaattttattttttatttataaagtttgggttattttttttgtagaatatttattttgggtgatatattttgagggtgtagaggaagaatttagttttttttttttttttgttttgagatggagttttattttgttgttaggtagatgtagatggagtgtagtggtgtagtgtttgtaattttttttttttgggttttaagtgatttttttgttttagttagagtagttgggattataggtagttgggattatagatatatgttattatatttagttaatttttgtatttttagtagagatggggttttattatgttggttaggatggttttaattttttgattttatgatttgtttgttttagttttttaaagtgttgggattataggtgtgagttatggtatttggttgaaattagtttttttttaatgtagaattggtatttatttattttgatgtagaggttgttgagttttagttgtaatagtatattttaaaatataaatatgtaaggtgtttgttagtatggaataaatatataaggtttttatatttttttttttagaagaagaaagttaaataaaattaaagtagtaggatagtgataaattgaatttttttagtgttttttttgttttaaagtgagtagtgttgggtgatttagttagtataggaataattgattagtagggtggtgtggttgaggtaaaggggatttaattgggagataaattggatttgtttattaaattatttgagtgtagtagtgatgttaattttgagttttggtagtggaatagaggggatttgatagtggatttggtttagaggggtttttgttatggtttagagtagtatttttttagatttgaagaagtaatgaagttaaggaaatagttgattagtgaaaaatttagttaagaggatggaaatataatagaagaatttgattttttttgaatatttagattggtgggatgtgttttttttgtttttggagttagagtttttgtttgtaaatatttggtaagaaaagatttgtaaattattaattaatttaatggaaaatgtaaaatgttaataattatgagtgtttttgattatagaagttattgttagtattaatatttattagatttatgtggttgtttgaagatatattattaattttgttatttattttatagaatgaagtgttttggttaaatatagagtttaataattattgttggttttttatattagttggttttgtattttatgtggatttaattaattgtggattgaaaatatttggatttagttgggtgtggtggtgtatgtttgtaattttagttatttgggaggttgaggtaggagaattgtttgaatttgggaggtggaggttgtagtgagttaggataatggtattgtattttagtttgggtgatagagtgagattttgttttaaaaatatatgtatgtgtatatatttgggggaaaaataataatata

SEQ ID NO: 1062 - DNA, 6173 bp, Artificial Sequence
  chemically treated genomic DNA (Homo sapiens)
tgtattgttattttttttttaaatatatatatatatatatatttttgagatggggttttattttgttatttaggttggagtgtagtgttgttattttggtttattgtaatttttattttttgggtttaagtgatttttttgttttagttttttaagtaattgggattataggtgtgtattattatgtttggttaaatttaaatatttttaatttataattggttgaatttatatagggtgtagaattaattgatatggagggttaatagtaattattaggttttgtatttaattagaatattttattttatgagatgaatagtaaagttaataatatatttttaaatagttatatggatttggtagatattaatattggtaatgatttttatgattaaaagtatttataattattaatattttgtattttttattaagttagttaataatttatagatttttttttattaagtatttgtaaataaaagttttgattttaagagtaagaagagtatattttattaatttaaatatttgaaaagagttaaatttttttgttgtatttttatttttttgattgggttttttattaattagttgtttttttagttttattgtttttttgaatttggaaaggtattgttttaggttatggtgggaatttttttggattgagtttgttgttaggttttttttgttttgttgttggagtttaaggttgatattattattgtatttaggtggtttaatgaatgagtttaatttgttttttagttgggttttttttattttggttatattattttgttggttagttgtttttgtattgattgaattatttagtattatttgttttgaaatggaaggaatgttgagggagtttagtttattattgttttgttgttttgattttgtttgattttttttttttgagaaaagaaatgtaaaagttttatgtatttattttatattggtaaatattttatatgtttatgttttaaaatatgttgttgtagttagaatttagtagtttttgtattaaaataaataaatattgattttgtattaaagaaaagttggttttggttaggtgttgtggtttatgtttgtaattttaatattttgggaggttgaggtgggtggattatgaggttaagagattgagattattttagttaatatggtgaaattttgtttttattaaaaatataaaaattagttgggtgtggtggtgtgtgtttgtagttttagttgtttatagttttagttattttggttgaggtaggagaattatttgaaatttggggggaggaggttgtagatattgtgttattatattttatttgtatttgtttggtgatagagtgagattttattttaaaataaaaaaaagaaaaaagttggattttttttttatatttttaaaatgtattatttaaaatgaatattttgtagaggaaataatttaaattttgtgggtaggagataagattagtagataaattgggaaagatatttagagatggagtaagttgaaaagattaattttttatggataatatattttagatgtatgattgtattgtttgttttagtttatttggttaaaaatataaaattagtaaagttttttaaaatttatattttaaaattagatttttgaatttagtgttttatgagtatagggtgtggtatattttaaagttattgtttatgtagttaggtagttattagtaggtattttagtagttttaagatattattttggggttttgtttttgtttttgttttaaaaaaaaggttaggtataatggtttatatttgtaattttgtaagtttagtatttttggaagttaaggttggtggattatttgagtttagaagttttagattagtttaggaaatatagtgagatttttttatttttatatatataatttttttttaaattagttaggtatggtggtgtatatttgtggttttagttattttggaggttgaggtagtaggattgtttaagtttaggagtttgaggttgtagtaagttatgattatgttattgtattttagtttggtttatagagggagattttgttttaaaaaataaaataatttttaaagatataaaatttttaaagtaaaagaataaaatatagaaagtattttaggtaagattataaataatgttttaagaataaatagtttgatagaaaaatgttttttttattgttttagaagaatttgaaatggtttttttattttttatttgaattgtttaaaagtttagagttatatatttaaagttttatagaataaaagttataaagatataaggagtttgtgattagtgattaaaggttaattattaaaggaaatattggaaatttagataatattagggtgtgttaattgtttaattatatttatgtgaaataaattttttttaaagaaaattattggatatgtgtttgggggaggaaggaggtgttttttttagaaatgtagttttagatattaattataataatatttttttatgaggagaggaaatttttaggtgtgtattttgtatttgttgggtttttgaagaatgtttatttttattttttttattttttttagttggtttgtaggtgatagtgttgatggtattgaatataaatattaggatatgagtataagagtttttgatatatgtaggatgaattagtgggtagtttagtaaagataggttgatgtgggtggataggagttatatagtaaaaggtaaaagaaggtagatgttagagaaggtattgtaaggaaaagtatttggaattttaagaaggaaagttatttttttaaggggagtagtagatatgatagtttggggatataatgtgtgttttttaagaaaggtgaggagtggttaaggaaaaaaggggttgtttaatgtaattgggaagagggagtgagagttttgtaggtagggtggggaaaattttatggtgaggttttgggaaaattgaggggagtgattaggaatattttggggtttagggatgagaatttgggatattattgaaggggtgggatagagaggaaattaaagagtaaggtttggttaaaaaggttagaggagtggaggtgggagagggaagaatgattttgaagatttaaggtgatgggtgggagattgaggggaaattgaggtttttatttgtgttgtttttgggtttgtgaaagtttatgatttggttgatgtgttgttttgagtttatgagtagttttttttgatgtagttttgtttgatgttgggaagttgatagatttgagtttgttgggatttttggtttttttttgttgttggtagtgatggttattgattttatttttttgtttatagtttgggaggggtggtagtggtggtgatgttggttgttgttgtgagggtgatgattagaggttgggttgtagggtgtgtgttttttttttattatagatttgtttttgagtgtggttttggagtttgtgagttaagtatttatgtattgttttatgtgattaagtgtgaggttttggttgttattttgagtgagggtagtgttggatgtttttgtgtttttttaatttttttggtttttatttaatagttttttttgttgtttatttggaggtgaagaaaattagtatttagggttgggagtggtggtttatgtttgtaattttagtattttggaaggttgaggtgggtggattatgaggttatgattttgagagtagtttggttaatatggtgatttttttttttttttttttatttgtttttattaaaaatataaaaatttagttgggtggggtggtgtgtgtttgtaattttagttatttgggaggttgaggtaggagaattttttggatttaggaggtggaggttgtagtgagttgagattgtgttattgttttttagtttgggttatagagtgagattttgttttgagaaaaaaaaaaagaaagaaaagaaaattgggagtgggaaagggatggtagtaagtaggttagtttagatttggtgttaggaagtaaaatggaggttgtagtggtagttgtttgtttatagatttgtggttttgtttgtaggtaatgggaatatgtaattttgggagttgtatttaaagggagttttatgttgggatttgtttttggtgtttgttttttatttttaatttttttatggtaaagtatatggttgatgtgtttttaggttttttttgtgttttgtgtgtttttatttaaattagaattttttattgaaattttttgtgtatattttatttaaattgttaatattttttatttttttttattttgttttttttttttgttgtttatgattattttgtatgttaaagatgttttagtttgggtgatagaatgagattttgttttaaaaaaaaaaaaggaaaagaaaagaaaaaaataaaaaggttgggagtggtggtttatgtttgtaattttaattttgggaggttgaggtaggtggattatttgaggttaggagtttgagattagtttggttaatatggtaaaattttgtttttattaaaaatataaaaattagtttgatttggtggtatgtatttgtaattttagttatttgggaggttgaggtaggagaattgtttgaatttgggaggtagaaattgtagtgagttgagattatgttattgtattttagtttgggtgatagagggagattttgttttaaaaatatatatataaaagaaataaataaaataaaattagaataaatgattgggtgtggtggtttatgtttgtaattttagtattttgtgagggttgagatgggtggattatttgaggttaggaatttgagattagtttggttaatgtggtaaaattttgattgtattaaaaatataaaaattagttgggtttggtggtgtgtgtttgtggttttagttatttgggaggttaaggtgggaggattatttgattttggggaggttgaagttgtagtgagtaatgattgggttattgtattttagattgggtgatatagtgagattttattttaaaaaagtttttttagaaaaaaataatatatttgttatattgtaatggatttagtttggattatagttattattaatagtaatatagttataaaatataattttaagtatgtttttaggtaggaaggagttataaaggtaaaagagtttagggtttttgaaagttataatgtagttttggtatttagtaatgatttattaagtgaatgattagatgaatgaaggaattgaatttattaatttttgttaatagggagtatggttagtttatatttgaggttgaggagggttttgaagtagtttattgggtgggttttttgtaattaagtttgttatataattatttttaaaataaggaagtgggtgaaatattatttagaagataataaaatattatatttatattaatattgaaaaagaagtgaaaataaaagaaattttggtttggatttaataatataaggagtttaaagaatatatagattgaatttttatttttgattggatgaaagttaaattttagggatatttattagttaataattttaaagtattagaggaagtttttttgtatatttgtatagatatagatttttgagttttagatttttttaaaataattttatatataattgaaaataatggaaataattgttaaatagtaataaatgtgtagaatttgatgaggtatagttttgattaattaagatggttttagaaagggtttgaggagttaaattagaattatagtgttatatttaatgatataagtattaagtaaattatttttaagtaatattttatttttttttgaaattgaggaagttgtataattgaatttgaatagaattataaaaaatgtttgggttggtatgtgggaggtttaggtaggaggattatttgtggtaaggagtttaagattgatttgggtaatatagtgagatttttttttttatttaaaaataaagaaaagagattgggaggttaggtgtggtggtttatatttttaattttagtattttgggaggttgaggtgggtggattatttgaggttaggtgtttgaaattaatttggttaatatgatgaaatttatttttatt

SEQ ID NO: 1063 - DNA, 6514 bp, Artificial Sequence
  chemically treated genomic DNA (Homo sapiens)
tgttattattttaaaagatgtgaattttattatttagagtttttagagagagttttttagatagtattttaaggagttaattttttttaaattatatatgtattttttagttgttgtttttttaaaagaatattttatatttaagaatgttgttttatttttttgagatagagttttgttttattgttaaggttggagtgtagtggtgttttttgtaatttttgttttttgggtttaagtggtttttttgttttagttttttgagtagttgggattataggtatgtattattatgtttggttaatttttgtatttttagtagagattgggttttattatgttggttagggtggttttgagtttttggttttaagtgatttgtttgttttggttttttaaagtgttgggattataggtgtgagttattatgtttagtttttgttttggttttaaaagtatttataatatttaaatgtttatgttggttatttatttttatttagtttataggtagaaaaaaaaaagtttatttagattaaattttgtagtaatttttttttttattgttattattgttaaagaattgtgtgttattattaggttaagttggtgtagtatttaaaatatttgttaatttgtttttttttagattggaggggtttaggtagtttttttaggatttattatattttgtattttaattttattaataatatttttattttttttgtattagtgatttatttaataaattaaattatatattattattaggttagtttttaaatagtttagtagtaataagaataataagatgttggttgtattttaattttattggtagaaattgagggttttattggtgaagaaatttgtttaggattatagtgttttagttttttagggttattataataaaatattatagatagggtggtgtaaataatagaaatttgtttttttatggttttggaaattagaagtttaggagtaggtaggtttggttttttttgaggtttgttttttttatttgtagagggttgtttttttattgtgtttttataaggttttttttttgtgtttattatttttggagtttttttttgtggtttaattttttttttttataaagatattagttaaattggatttagggtttattttaatggttttgttttaatttaattatttttaaatgttgtgtttttagatagttatattttgaggtatttaggtttttatagatgaattttggaggatataatttagattataatataaggtaatatatggtttagatgagatttgaatgaatgattagtttaatttttaagtagatttttttagtagattgtaaggtgtattggagagttttagattagaggtttaagaggttatttaggtaatatttatagaattgttaagtgttaggattgggggatgtagtagttatgaaaattgttttttgttttagtaagtttatagtttattatggggaagagataaatattgaataggtagttatattatttttagtaaaataataattgggaatagtttttggggattattttatatatggaggaaatgtaaaaaatattttgttaggattatttttgtagtaaattagatgtgattaggttaattaaatatggttattgtgaattattttattgagtatagaagtggttttgttaaaaatggatttttttatggagtatggtggtttatgtttgtaattttagtattttgggagattgaggtaggaggattgtttgagattagtttgggtaataaagtaagattttgttttaaaaaaaaaaaaattagggtgtggtggtgggggtttgtaattttaattatttgggaggttgaggtaagagtattatttgagtttgagaggtggaagttgtagtaagttgagattgtattattgtattttagtttgggtgatagagtgagattttgttaaaaaaataaaaaataaaaaaataaaaaaaattaattttttgtatatttttgttataaagaagtttttaaaaaattgtttgtttttttaagttagtttttttattgagtttaaattttgttttaatttgaataaatatggatgttaatattattttttatagttattagtgttaagtgtgttgtatgtaatattttgaatatttattgaagtttgtaaggttggttttatgttttgattattgatggagatataaattttgaataattgtgattttagggatgttaaatattatagtgaggtatgatgtggggatttgaattttggtttgagggttttagagttgtggttttttttggggttattttgttaattgatttttagttttttttgatttataagttgtggtattataatttttagatgttgaagaaaattaaattatatgttaaggattaaggtttgtgaatttttaaaatttgggataggttttagttaatttagaaagtttattttgttaatgttaaggatgtgtagttgtgatatagttttaggaagtttagatgatatgtgtttaaggtggttggggtatagattggttttatatattttagggagataggagatattaattaatatatgtaagtatattggttttttttagaaaggtggggataatttggaagtaggaagggtttttaggttataggtagatgagagataaaaggttgtatatgagtttttgataagtttttttaaaggagataattagaatatgtatttattttagtgagtagaaggatgattgattagaatgggaggtaggttttgttttgagtagtttttagtttgattttttttttttgtttagtaattttgggattttaatatttttataggttttaaattttattattttttagttattatgtgttagtatataaataaatagtataaaattaagaaggtatttattttttggttgtttttttatgtgtaaaataatattttgtgttaagtatttttatatatggtggtgtaaaggtagaaattgatattaaaaaagtgtgtagaaaatagtttttagtttgggtaatatagggagattttatttttataaaaataatttgttaagtatagtggtgtgtatttgtggttttagttatttgagaggttgagatgggaaagttgtttgagtttgggtagtaggagttttaggttgtagtgagttaagaatgtgttattggattttagtatgggtgatagtgtgagattttgttttaaataaaaataaaagtttgttattttattaagaaggtgtttttgtatattgttttaatgtttaatgtttttaggatgttagtgtgatggaagtaagtaattattaaggtattattattggtgttaaattttttatttttggagtgttgtaagtgtagaaaatatatgttatgtgtggaggtggagtttttgttttgtgtgttgtattagatggaaattgagtgggtttattttttatgggtttgtggatttattagtgaaggtgggaggtgttgtagggatattttttggttgtttttgttgtttgtgtggtttttgtattttggttttttattagtggtgtagatgtttgggtttaagtgttgggtgaggtgaggttttgtttttttttgttaatggttattttttggatttgttttttttttgggaggtggtgatagttgttgagatgtgttgtagttagagtttttttgttttaatgtgtttttattagtgttgttttttattggaaaattgtggtttttgtattatttgttatttttgttgtgtaggagtagggagggtttttttttggggttttaggtggtggtgtagtttgttgtagaagaattagagtagaagttgttggggtttgtttttaggatgtagttgttttatgggggtttaggggttttggaagttgttggagtgttttgggtggtaggttagttttgaagtgttggaagggaagattttggttgttggtatttttaatgttgtgttgggatttggggtgtagggatttggggttggattttttgtggggttttgttttgggtatagtggtatttgtaggatgatggttttgggttggggttggggttgttatagaatttttgttattaggttttttaagtatagttgttttttggtatttttggggttttggttttagttttttttttgtatattatgatgtttaagtttttttaatttttttatataatggtgtggtatttgtatataaattatttatttttgtaattttttaaattgtttttagtttatttgtaatgttgaatgtaatgtaagtgatttgtaaatagttgttatattgtattttaaaattttttgtagtttttattggtatgttttatttatttatttttttttattgtaaatatttttgatttgtggtaggttgattgtggaattgggtgatgaggtgggttgttttgtttgttttttttagttttgtagttttagtggtttgtgtattttggtttgttattttgtggtagtgttttatgtttttttttgttttagtttttttatttgtaaagtagaggtggtgatagtatttatatataggattggaatgaggaataaagaaattgtttatatgagagaagtttagtgtgattaatatagtaaattttaaagttattattttgtttgggaggttagtaaggagagtagagtagattttgatgattagttttgtttgagttttgttttatttatgttttttagaggaaggatagtgtggataggtgttttatttattttttaaattgattttttaaggattattgtttttgtatatgtttggttggttttgtttgttattggaattaaattttttttttattagtaaaatgtgatattgtttttgaaatttttatttttttttttgttatgtagttattttttttttttttttgagtatttattttggtttagaatttggtgatattttatattaattttttaaatggggatttatgagtttaggggtttgtgggtttgtggaaagagttttgtaaatgattgtggggggattggggatgggaaatggagtgtaagagtgtgtgggtgtttagtaaaggaatttttgattgtggagttttaattttttagtaggtataaaatttataaataaaatgatattgataagttttaaaatataatgagattattattttttgtaagtgaataatttttaaataaatttgtaattgatttttggtttaaaagtttttatatagggtattttgaattggggaaagttaaaggatttttgttttgttttgttttgttttttgttttttagagtatatgtgttgttgttgtttttaagttgttgtttagtattattgtagtttaaagatttttttagaaataaagggtaaaggttagtttttagtgataagaatttttaaaattttagtaaagatttagattattttatgtagtagtttttgtgaagaattattaaagaggattgtggttaggtttagtggtttatgtttgttattttagtattttgggaggttaaggtaggaggattatttgagtttaggagtttaagattagtttgggtaatatagtgaatttttgtttatatatagttaaaaaattagttggatgtggtggtttgtatttttggttttagttatatggaaggttgaggtaggaagattgtttgggtttaggtggttaaggttgtaatgagttgtgtttatgtttgtttttgaataaataaataaaaaggattgtgaaagatattttagttatgataattttatatatttataataaatttgtttatgttaaaggagtatatttgattatttgttttataattggttttgttttattttatttttatgggaatttagatatttgaaattatttagattttattgtattgtttgttaatgataaatttatttgttattatattagttttataatttatttttgtatttttatattaaattgtttggtttttaaattatttatatagtttagtgttttatttatatagtttaaatgtttgtgttaaataatgtagaagtaagttaaatttttgttttttatagattttaatgtttgtaatatgtgtttaagtgtattagtaagatattattatttttttaggttatgtatattaatggagatttttaagttatttaattaaagaattaaagaaatttattttttgtattgaaatgttattggtttttgggttttatattgaaagtgatttttggttttgttgtagattttaatttttttgtttgtagaaatttaattttgtgtatataaatttattgaaattagataagttaaattatataaatatttttagattgttttattttttatattttttgtttaataatttatgtgaatatttttaggttgtttaattttatatattttatttttaagaatttaagttaaaatttttaattttagttgagaattggtattatttgt

SEQ ID NO: 1064 - DNA, 6514 bp, Artificial Sequence
  chemically treated genomic DNA (Homo sapiens)
ataggtaatgttaatttttagttagggttgagaattttggtttgaatttttagagatgaaatatgtaaaattagatgatttgaaaatatttatataaattgttagataagaaatatgaaaaatgagataatttgaaaatatttgtataatttgatttgtttaattttagtaagtttatatatgtaaaattaaatttttgtggatagaaaagttaaaatttgtagtaaagttaaaaattatttttggtataagatttaaagattaataatattttaatataaaaaataagtttttttagttttttagttaggtgatttaaaaatttttattagtatatatagtttaaagagatggtaatattttgttaatatatttaaatgtatattataaatattaaaatttataagagataaaagtttaatttatttttgtattatttgatatagatatttagattgtataaataagatattaagttatatagatggtttaaagattaaataatttagtatagagatataagagtaaattatgaaattagtataataatgggtaagtttgttattaataaataatataataaaatttaaataattttaggtgtttgaatttttgtgaaaatgaaataaagtaaaattgattgtagaataagtaattagatatatttttttgatataaatgagtttattataaatatatgaggttgttatgattagaatgttttttatagttttttttatttatttatttagagatagatatgaatatggtttattgtagttttgattgtttgggtttaagtaatttttttgttttagttttttgtgtagttgggattaaaggtgtaggttattatgtttagttaattttttgattgtgtgtagataggggtttattatgttgtttaggttggttttgaatttttgggtttaaatgatttttttgttttgattttttaaagtgttgggatgataggtgtaagttattgagtttggttatagttttttttagtaattttttataagggttgttatataaaatgatttaaatttttgttgaagttttaagggtttttgttattgaaaattaatttttattttttatttttgagaaaatttttagattgtaatgatattaagtaatagtttgagggtagtaatagtgtatgtgttttaaaaaataaaaaataaaataaaataaaataaaaattttttggttttttttaatttaaagtattttgtataaaaatttttaagttaaaaattaattatagatttatttaaagattatttatttgtaaaaaatgataattttattatgttttaaaatttattaatgttgttttatttataagttttgtatttattgaagaattagggttttatagttagggatttttttgttgaatgtttatatatttttgtattttattttttgtttttaatttttttgtaattatttataggattttttttataagtttatgagtttttagatttatagatttttatttaggaaattggtgtaaggtattattagattttgagttagaatagatatttaaaaaaaaaaaaaaaatgattatataataaagaaaaagataaaaattttaaaagtagtattatgttttgttaatgaaaaaagaatttaattttaatgataaataaaattagttaaatatgtatagaaataatagtttttaaaaagttaatttaaaaaatgggtaaaatatttgtttatattattttttttttaagaaatataaatggggtaagatttaagtaaaattaattgttgaagtttattttgttttttttattgattttttggataggataataattttaagatttattgtattaattgtattaaattttttttatgtaggtaatttttttattttttattttaattttgtgtgtagatattattattatttttattttgtagatgagagaattaaggtagagaggaatataaagtattgttataaagtgataaattaggatgtataggttgttaagattgtaaagttggggaaagtagatagggtggtttgttttattatttgattttgtaattaatttattatggattaaaaatatttgtgatggaaaaaaataaataaataaaatatattaataaaaattataaaaaattttaaaatatagtataataattatttatagattatttatattgtatttggtattataagtaagttagaaatgatttaaaagattatggaagtgggtagtttatatgtaaatattatgttattatataagggagttgaaggaatttgaatattgtggtatatggaggaggggttggaattaaagttttggggatattgagggatgattgtatttagaaaatttagtgatagagattttatagtgattttgattttgatttaagattattattttgtagatgttattgtgtttaaggtagagttttgtgaggaatttagttttgaatttttgtattttaagttttaatgtggtgttaaggatattaatagttaggatttttttttttagtgttttggggttgatttgttgtttggagtattttagtagtttttagagtttttggatttttatgaggtggttgtgttttaagagtggattttgataatttttattttaatttttttatgatggattgtattgttgtttaggattttgggaggaagttttttttgtttttatataataaagatggtaaataatatagaagttatggttttttagtgggggatggtattaatgggagtgtattaaagtggagagattttggttgtaatatgttttagtagttgttattgttttttggaagaaagataggtttagagaatggttgttggtggggaggggtagggttttgttttgtttagtgtttaggtttaaatgtttgtgttgttaatggaagattggggtgtaagggttatgtaggtgatggaaatagttagaagatgtttttgtgatattttttgtttttgttggtgggtttgtaaatttatgaaaaatgggtttgtttggtttttgtttaatatgatgtgtagggtggaagttttgtttttgtatatgatgtatattttttgtgtttgtagtattttggaagtgagaagtttagtgttagtggtgatgttttggtggttatttgtttttgttatgttggtattttgaaggtgttaagtattaaaataatgtgtaaaagtgtttttttggtggagtaatgggtttttgtttttgtttgagatagggttttatgttgttgtttatattggagtttagtggtgtatttttagtttattgtagtttggaatttttgttgtttgagtttaagtaatttttttattttagttttttaagtagttgggattgtaggtgtgtattattatgtttggtgaattatttttgtagaaatgaggtttttttgtgttgtttaggttgggaattattttttatatgtttttttagtattggtttttatttttgtgttgttgtgtgtgaagatatttaatataaagtgttgttttatatgtgaagagataattaaaaggtggatgtttttttggttttgtattatttatttatatgttagtatgtagtaattaaagaataataaaatttaaagtttgtgaaaatgttagggttttaaaattattaagtaaaagggaaaagttaagttgggaattgtttagggtaaaatttgttttttattttagttagttatttttttgtttattgagatagatgtatattttgattgttttttttggaaaggtttattagaaatttgtatgtagttttttgttttttatttatttgtgatttagaagttttttttgtttttgagttgtttttatttttttggaaggaattagtgtatttatatatgttgattgatgttttttgtttttttaaaatgtataaaattaatttgtgttttaattattttgggtatatgttatttggattttttggggttgtgttatagttgtgtgtttttaatgttggtaaaataaattttttaaattaattgagatttgttttaaattttgggggtttataagttttaatttttgatatatagtttagttttttttagtatttaaaagttataatgttgtggtttgtagattagaaaggattagaaattaattaatagagtaattttagaaaaggttatagttttggaatttttaggttaagatttaaatttttgtattgtgttttattatggtgtttagtatttttgaagttatagttgtttagaatttgtgtttttattagtaattagggtataaaattaattttgtagattttagtaagtatttaaggtgttatatgtaatgtatttagtattagtaattataaaggatagtattagtatttatatttgtttaaattggaatgaaatttaaatttagtgaaaaggttgatttaagggagtaggtaattttttaaagatttttttataatagaagtatatgggaaattgattttttttatttttttattttttatttttttgatagggttttattttgttgtttaggttagagtgtagtagtgtagttttagtttattgtaatttttattttttaggtttaagtgatgtttttgttttagttttttgagtagttgagattataggtttttattattatgttttgatttttttttttttgagatagggttttgttttgttgtttaaattggttttaaataatttttttgttttagttttttaaagtgttggagttatagatatgagttattgtgttttgtggagaaatttatttttagtaaaattatttttatgtttaataagatggtttatagtggttatgtttggttgatttagttatatttaatttgttataggaataattttgataaagtgttttttgtattttttttatatgtaaagtaatttttagaaattgtttttagttgttattttattgagagtaatataattgtttgtttagtatttgttttttttttatggtaaattgtaaatttattgaaatgaagaatgatttttgtgattgttatattttttaattttggtatttagtagttttgtaaatattgtttaaatgattttttaagtttttagtttaaagttttttagtgtattttgtagtttgttgaaagaatttgtttggaggttaggttgattatttatttagattttatttgaattatatgttgttttgtgttatggtttgaattgtgttttttaaaatttatttgtggaagtttgagtattttagaatgtgattatttgaagatatagtgtttaaaaatgattaaattgaaatgaggttattaggataggttttaaatttaatttgattggtgtttttgtagaaagaggaaattgggttatagggagagattttagggatgataggtatagaggaaaggttttgtgaggatatagtgagaaggtggttttttgtaggtgaaggagataggttttagaagaaattaaatttgtttgtttttggatttttagtttttagaattatgagaaaataaatttttgttgtttatgttattttgtttgtggtgttttgttatggtagttttgagaaattaagatattgtgattttaggtaggtttttttattaatgaaatttttagtttttgttagtaaaattagaatgtgattaatattttgttgtttttgttgttgttgagttatttaagaattgatttggtaatggtgtataatttagtttgttgagtgaattgttggtataggaggggtgggagtgttattggtaaagttgagatgtagaatgtgatggattttagaagagttgtttgagtttttttagtttgggagaagataagttggtaagtattttgggtgttgtattaatttggtttaatgatggtatatagttttttaatagtaatagtagtagggaaaggaattgttgtagaatttgatttaaataaatttttttttttttgtttgtgagttgggtaaaaataaatagttaatataggtatttgagtattgtaagtatttttaaaattaaagtaaaggttgggtatggtggtttatgtttgtaattttagtattttgggaggttgaggtaggtagattatttgaggttgggagtttgagattattttggttaatatggtgaaatttagtttttattaaaaatataaaaattagttgggtatggtggtgtatgtttgtaattttagttatttgggaggttgaagtaggagaattatttgaatttgggaggtggaggttgtagagagtattattgtattttagttttggtaatagagtgagattttgttttaaaaaaataaagtaatatttttgaatatgaaatatttttttgaagaaatagtaattaaggggtgtatatgtgatttaaaaggaattagttttttaagatgttatttaaagggttttttttaaagattttgaatagtaaaatttatattttttggaataatagta

SEQ ID NO: 1065 - DNA, 6325 bp, Artificial Sequence
  chemically treated genomic DNA (Homo sapiens)
agttttttgagtagttgggattatagttatgtattattatatttatttaattttgtttatttttttgtagagataaggttttattatgttgtttaggttggttttgaatttttgggtttaagtaatttttttattttggttattttaagtgttgggattatagatgtgagttatggtgtttagttttttttttggtttttgattgtgtttttgatagttgtgagatggtgttgttttattaagtaatatgttttgttattatattataattttgtagttgttgggattttatgtaaaagtattttattttaatgttgttttaattttttttatggtattatatttggggggaaatttttttttataaataagaattttggttttgggtatttatagatggtatttaatttattttttttaatgtttttgtaaaatagatgtttttttttttttgttagttgaggaaataaggtttagtatggttaaatagttggtttaggttatatagttaatgagggagaagttaggatttgaatttgagttttattttaaattttattttgttattgtagtagaatttttatttattaaggttaaggatgtttagatggttttgtgtttttgtattttatttgaaaaatgtttttaaaagttggtagatgagttttaattgtggttttttatttttttttttatgtattttttgagtatgaggtttggttgaaggttagtttttaggtgtttagggaaagggttattttttttaaaatagtagtagtttaggttagagtttatagatgttttagttttatgtggtaagtttttttgggtttttatttgtatatggagttgaagaggtttgttttttgatagagaaataaatttttagggtgttgagaatggtgataggatgaataggttgtaggatttttgttattaagtgatatttaatgttgatagtgagtgatggtttttttgggaggtgttttttagagtatattttgttatattattttgatagttattttttttgtaagattgatataattattagttatttttatataaatgtaaaagtaaatttttttagtgtttttgggaaattttatgttgttatattttagaaaatgatgttgattttttggtattttgtttgatattgatattgaataagagtagtggaaagttagtttttgtgaagttttggaattattgtgattttgagtgttagtattaaaagagtttatttaaatatttttggttatgttgttagaaaatagtgtattggaggtaattttaaaatgttttgaataattttgtttttatttttttttgtttttggttatagtttagatatattttaggtttattgttttgtgggtgaagataagttgggaaatgtggaagagttttttatttatttattagaggttttatttgaatttagttgtgagtttgggttgggagtgtaggaagtggttgtgttgaatgtatagtatgaggggatggtggggtttttaggtgtgttttaaattttttgtatttatatagagatgaattttttttgtagtagtttttagtgaggaggtttaggattttaagttttgagggtttttgagtttgttataggttagggatagggatttggttgttgatgggtgatatgttgttagttatagaatggggttgattgggtattgggagtttggtgatggggtgttatggatatttttataggtttagtttgtgtttagaattatagagttgagttgatgtatgttatggagaattgtttttgttttgtatatgtatgttgtattaggggtttgttttgggtggtttagttggttgtgtttttgtttgtttagggtgagtttttgtatagggtttggttttgtggagtttatttggtggttaaagatggtgttgtagttttagtttgtttgtaggtttagtattttttgttttttagtttgttttaggtttttagattgtgtggtgtaaaggtttttggaggttagttttgggttggttgtgaggggagagttaggtgttgtagttttttttggtatagattttagttgtttttaggatttggggtttgaaggaggtagaagttggtggtggaaaagggtgtatgttttttttagtgttgtttttgttgtttgttgtttattgtagtttatttatttgtttttttagttatttttttagttttgggttgggagagattatttttttttttttggagggatgagttaatagggttgagttttttatttttttggtggttagtttgtttgattattatgttttttttttttagggttttagtttttgggttgtggtttgtttgtattttaaagttatataatgtgggtggttttggtgaggtgggaggggttggggtagagggagggtttttgtttttttatttttagttttgtttttggagtttgtgatggagttttgtgaagatgtaggtgttggggttgtttggtgatgatgatattattgtgttatatataggagttggttgttggggggtttaagagaagagttttttggattatattggtgtttatgtttatatttgtatgttttgggtagagttgtgtatgttggttatatttgggtgtgtgttggttatatttgtgtgtatatatatgtggtgtttgttttttggtttttggtttgggttgtgagttgtagttttttgttgttgtttttgttgttatggatgtttgtagttgtttttttttgtagtgtagtaattttggttgttggttggtttgttttggtttttggttgtaggaattgtgttaggatgttggttttgtttgtggttagtttgtatgttagggtatagtgaggatgggagggttgtagtttttgtagttagttttagttagtgatttgaatttggaggtttttgaggtaatgtaagtgttttgtttgggttgttttgagttttttggggaggaggagaggatgtttgggttttgttagtgttgttttttttaatgtttgtgtaatttggagtttaggttggtttggggttttttgtagttttggaaagttttatttggggttgttttgggaggagtatttggtagttttaagttattgttgtgggtagaaatgattttttggaatttagttttggttgtttagtagtgggtgtatggttggggggttttttttgttgttagtattttttttttgtatttttggtatagtggtattttttgtaagggaatagttaggtattagtgattgtttttttttaggaagaatttatgagtgtggtagttttgtgtttggggtgatagtttagtttttgggtagttgtgtttgtggttgggtagatggtgtggtgtgttttggtggatgttttgtttagttagtttaagtattatttatatattttggtgaatatttgaggataaggttgtttgttattattagtaaagggttgaattgttttgttattggtggaggtagtgtttgattgtgtattgatttaggaatttgatttttttttttaattatagagttaatgtgtttagaagtggtttttattttggttgagtgtttattagaatttatgtttttgttatggttgtttttattatttatttaggtatgtttggatgatggggtgtattgaatgggtttgttggttgggttgtattttagtaatttaggtttgtatttaaagtggattttttagttttatttgtttttatttttttagagagaagattatgttttagagaagagtattttttggggatttgggggtaggggtagtaaagtgggtttttaagagttatggatgtgtagattaaaagatggtggggattgatttgtgtgttgtaggagggatggggttttggggggtatttttttattggttttttgatttttgggttttagtgaggagttggtttggtgtagtgatgtaatgttaggttgagttttgtggttttttgggttttagttttttagtagggagttatttttttgagtaggtgtgtatttattatttgtttttatttttgtagtttgagaaagtattgttttataatggaggtatattgtgtttgaggattttttttttaaatgttatgatttttgtgttgtgtttgttttgttttttatgtatgtgtagtgttgttaggtgtatggaaatataatttgagtttaggtagaaaagaattattttaatttattttttgtaagtttttatagtggaattgagttaattagtgataggtattggttaatttttatggtttagatttatttagtgaagagtttaggaaatagaaaggataatgtgattgtatgtttgggaaaatgtgttttttagttattggaaatttagtttgttggtttttaatgtttttgtttttttttttagttgagttaataaatgattagtgttttgttagttgagggttgagtttagatagtttttgttaggtagttgtgtttttttggataaggttttttaaggttttgtttattgggatagtggtgtttaaataaaattttaggttgaatggttatattgtgatggaagttgtttattaaatatttttatagttgagttggtttatatgtttttgtttgaggtttttttttttagaattgttgtttttgaaatgtttttaaatatagatttttatgatagtatatttatttatttataaaattttattttttattttgtaatatttttgttttaaaaaaatggagagagaggaaatatttggggttagtgttattgttagtatttgttttttttaaaatttgtttttgttttttgaataattggggtttatttttttagtgtagatgtgtttttttttagtttagaggttttaaaaatatatatttggagagtgttttttttttgtttaggtataggttttttttggtagtatttttatgtagttaaaaatgtatgtatgtgaataatatataagatagtaatagagtgtggggtttatggtaggaaagaggttgtattgtaagatgatgttgttagggttgtagggatggtgataaatatagggtgtgtatttgttgtgggggatagtttttgataattggaatttagagtgaatgtttttttttttttttgttggttttttgtgaaagattggtttaaggagggttatggtgtaagagtgaaattaaaagatagaggatttggaagtgattgaaggatttttttttaatttaaattttttagttttaagatttttttttttttaattgtaggtttggggtgtttttgggtagtttttgtagttttagttgatagttttattttatgtaggagtgtattgggttagggagggagtgatttttgtatttttttttttgagaatttaggtattaagattggagtagtagaagttttatgggattggggattgaagtttgaggatgaaggtgtaaatggtgattagttttttgttatttttagggttggttatatatgatagtattagttttttaaaggggtttgttagaaatgtagagttttagattttattttagattagttgaattagaatttttattttatttagggatttgtaaagatgtttaggtgatttgtaggtattttaaaatttgagaagttatgagttggtttagttttttttttattttgtttatgagaaatagttggttatttttttgattgttttttttttatttggtaaagaagtttttgtagtaatagtgattatttgtttttaaatagaatatgagtagtaaggggagggagaatttttttatagaaaatatttattttttagtatggatggtaggagatataggaatggataggaagtatttgagtaaatgtgggttgtagttattgattagatttgttgtttattttttgattttgtggtagttttatgtggtgtggtttttgttaagtggggtagtattaagtattttgttttttatgtagttggagatttttgttttaggggtttttttagtttttattaaatttttatattttggttattgaaaattatttagggggttattattagagagtaaaagtggtggttttgttggtaaagttggtttgttttgattgttgttttatttttaaagtgagtatgtgtttttggttttaaaaaataaattataaatatggaaatttatattttgtagatttgtggattgaagtagaggggttagggtggatgggagagaagtgatggaggaggaagtaataggttttgtgattgatgagatgggggagggaagagaagagatagtggtaagt

SEQ ID NO: 1066 - DNA, 6325 bp, Artificial Sequence
  chemically treated genomic DNA (Homo sapiens)
atttgttattgttttttttttttttttttttattttattaattatagagtttgttgtttttttttttattgttttttttttatttattttggtttttttattttgatttataggtttatagagtatgggtttttatatttgtgatttgttttttagagttaagggtatgtgtttattttgagagtagggtaatagttggggtaggttgattttgttaatagaattattgtttttgttttttgataatggttttttgggtggtttttagtggttagggtgtggggatttggtggaagttgagggaatttttgaaatgggggtttttaattatataaaggataaagtatttaatgttgttttatttagtagaagttatattatatggggttgttatagaattaagggatgaatagtaggtttgattaatagttgtagtttatatttatttaagtattttttgtttatttttgtgttttttattatttatattgagaaataagtgttttttgtgggagaattttttttttttttgttatttatattttatttagaaataaatggttattattgttataagaatttttttgttagataggaaaggagtagttagagaagtggttagttgttttttatggataggatggagggaagattgaattagtttatggttttttaaattttgagatgtttataaattatttgggtatttttataagtttttggatgaaatggagattttgatttagttggtttggggtgaggtttgaggttttgtgtttttagtaagtttttttgggaagttgatgttgttatgtgtggttgattttgggagtagtaagagattggttattatttgtatttttatttttaggttttaatttttagttttatgggatttttgttattttaattttgatgtttgagtttttaaaaggggagatataaaagttgttttttttttagtttaatgtatttttgtatagaatgaagttgttagttggagttataaaagttgtttaaaggtattttaaatttgtaattggaaggaaagaaattttaaaattaaaaaatttaaattaaaaaaaaattttttagttatttttaaattttttattttttgattttatttttatattatggttttttttaagttagttttttatagggaattagtagagaaaaagggaaatatttattttagattttggttgttaggagttgttttttgtggtaggtgtgtattttgtgtttgttattatttttgtagttttgatggtattattttataatgtaattttttttttgttatgggttttatattttgttgttgttttgtgtattatttatgtgtatgtatttttagttgtatggaaatattattaagaaagatttgtgtttgggtagaaaagaggtattttttgaatatatatttttaaaatttttagattgggaaagagtatatttgtattagaaaaataagttttagttatttagagagtagagatgggttttgaagaggatagatgttagtaatggtattggttttaaatattttttttttttttatttttttagaataaaaatgttatgggatggagggtgggattttgtgaatgagtgaatatattattgtaaagatttatatttagagatattttagaggtagtagttttagggagagaagttttaggtgggggtatatggattaatttaattgtgaaaatatttgataaatagtttttattataatgtggttatttagtttgaaattttatttaaatattattattttagtgggtagaattttaagggattttatttaaaaaggtatagttatttaatagaagttatttaaatttggtttttagttgatggaatattgattatttattaatttagttgaaaaagagggtggggatgttagggattggtgagttgaatttttaatgattgaggagtatatttttttaaatgtatagttatattgttttttttgttttttaagttttttattagataggtttgagttgtgagagttggttagtgtttgttattgattaatttaattttattatagggatttgtaaaaaataggttaaagtggtttttttttgtttagatttgagttgtatttttatgtatttagtaatattatatgtgtatgagaaataaggtaggtatagtataaggattataatatttaaaaagaaaatttttaaatgtgatgtgtttttattgtaagatgatgtttttttaagttataggggtgaagataaatgatgggtgtatatttgtttggaagaatgattttttgttaaagagttggagtttagaaaattatgaggtttagtttagtattatattattatgttgagttagttttttattgaagtttaggggttgagggattagtgaggaagtattttttggggttttattttttttataatatatagattaatttttattattttttaatttatatatttatgatttttaagaatttattttattatttttatttttaagtttttagaaaatatttttttttgaaatatagttttttttttggaaaagtgggggtaggtgaggttgggaggtttattttggatataagtttgagttgttgaaatgtgatttggttggtagatttatttaatatgttttattgtttaaatatgtttgggtaggtaatggagatgattataatagaaatgtgaattttaataaatatttggttaggataaaggttatttttgagtatgttagttttgtggttgagagaaaagattggatttttggattgatgtatagttaagtattgtttttattaatgataggatggtttggttttttattaataatagtaagtggttttgtttttgagtgtttattagagtatgtggatgatgtttaggttaattagatggaatgtttattagagtgtattatgttatttgtttagttataagtgtagttgtttggaaattgggttgttgttttgggtatggagttgttatgtttatgggttttttttaggaggaggtagttgttgatgtttggttgtttttttgtaggaaatattattgtgttgggggtgtagaggaaagatgttgatggtaggagaagttttttagttatgtatttattgttgagtgattaaaattgaattttagggaattgtttttgtttatagtagtaatttggggttattagatgttttttttagagtagttttaggtaaagttttttaaggttgtgaagaattttaggttagtttgggttttaggttgtataggtattaggaaaggtgatattaataaagtttgggtattttttttttttttttgggagatttggggtggtttgggtggagtatttatattgttttggaagtttttaggtttaggttgttggttggggttggttgtagggattgtgatttttttatttttgttgtgttttggtgtgtaagttagttgtgagtggggttagtgttttggtgtgatttttgtagttgggagttggggtgagttggttggtggttggggttgttgtattgtagaggggagtagttgtgggtatttgtggtggtgggagtggtggtagggagttgtgatttgtggtttgagttgggggttggggggtgagtgttgtgtatgtgtgtgtgtgagtgtggttggtgtgtgtttgagtgtggttggtgtgtgtggttttgtttggggtgtgtgggtatgagtgtgagtgttggtgtggtttgaaaggttttttttttaaattttttggtagttggtttttgtgtgtgatatgatgatgttattattgttgagtagttttaatgtttgtatttttataaagttttattgtgggttttggaaatggggttgggggtggggaggtgaagattttttttttgttttggttttttttgttttgttgggattgtttgtattgtgtagttttgaaatgtaaatgagttgtggtttgggagttggggttttagaaaggaggggtgtggtggttgggtgggttgattattgagagagtagggggtttagttttgttggtttatttttttaggaaggaggaaatggttttttttggtttaggattaaggggatggttggaggaataggtaaataggttgtagtgggtagtgggtagtgggagtgatgttgggagagatgtgtgtttttttttattgttggtttttgttttttttaggttttgggttttggaggtagttgaagtttgtattagggagagttgtggtatttggttttttttttatagttagtttggggttagtttttaaggatttttgtattgtatagtttgagggtttggggtaagttagggagtaaaaggtattgggtttgtgagtgggttggggttgtaatattatttttggttattaaatgagttttataaagttaagttttgtgtaaaggtttattttaaataagtagaggtgtggttagttgagttgtttaaggtaggtttttaatgtagtatgtgtgtatagggtaaaggtagttttttgtgatatgtattggtttagttttgtgattttaaatatgggttgggtttgtaggaatgtttgtgatattttattattaagtttttagtgtttagttagttttattttgtagttggtagtatgttatttattagtagttaaatttttgtttttggtttatggtaggtttagaaatttttaagatttgagattttgagtttttttattggaggttgttgtagaaagagtttatttttgtataggtataggaggtttggggtatatttgggaattttattatttttttatgttgtatatttaatataattgttttttgtgtttttagtttagatttataattgaatttaaatggaatttttgatgggtaagtggaagatttttttatattttttagtttgtttttatttatagggtagtgagtttaaaatgtatttaaattgtggttaaaagtaaaagaaaataaaaataaaattgtttaaagtattttaaaattgtttttaatatattgttttttagtgatgtggttaaggatgtttggatgggtttttttgatattgatatttgaggttatagtagttttagagttttatggggattgattttttattgtttttatttagtattagtgttaaatagaatgttagaggattaatattgttttttgggatgtaatagtatgaaattttttagaaatattgagaaggtttatttttgtatttatatgaaaatagttaatgattatgttaattttgtggggaaggtggttgttggggtggtgtgatgaggtgtgttttggaaagtattttttggggaagttgttatttattgttagtattggatgttatttggtggtaaggattttgtaatttgtttattttgttattatttttagtattttgggggtttgtttttttgttagaaaatagatttttttggttttatatgtaggtgagggtttaaagaagtttattatgtggagttgaaatatttgtaagttttaatttgggttattattgttttgaagaaagtggttttttttttgggtatttaggaattggtttttagttaagttttgtatttagaaaatatatgaggaaaaaaatgaggaattataattagaatttatttgttaatttttaaaaatattttttagatgaggtgtaaaagtataaagttatttaaatgtttttagttttaataggtaaaggttttgttgtgataataagatagggtttgaaatgagatttgagtttaaattttgattttttttttgttagttgtgtggtttgagttgattgtttaattatattgaattttatttttttagttggtaaaagaggaaaagtatttattttgtaagggtattggaaaaagtaaattaaatattatttatgaatgtttaggattaggatttttatttataagaaaaaatttttttttaagtatagtattataaaggaaattaaggtagtattaaagtgaagtgtttttatgtagaattttaataattgtaaagttatgatgtagtgatagggtatattatttagtgggataatattattttatggttgttaaaaatataattaagaattaggagaggggttgggtattatggtttatatttgtaattttagtatttggggtggttgaggtgggaggattgtttgagtttaggagtttaagattagtttgggtaatatagtgagattttgtttttataaaaaaataaataaaattaggtgggtgtggtggtgtataattgtggttttagttatttaggaggtt

SEQ ID NO: 1067 - DNA, 6214 bp, Artificial Sequence
  chemically treated genomic DNA (Homo sapiens)
ttgatgagaaaagatttatatatttagtgggtttttggtttttttttttttgtttgaggttttgagtattattttgggaggagagaggaagtaattttaaagttgagtgagtttggagtttttatggtattttggagttatttttagaataggggaagttggtattttattttttggaaaaggggtgttagttagttgttattattatatagttttgtgatttttatagttttttttatggaggttttttatttagggaagggaaatttaggttttttggaaggagagggaagaggaataggtgttatatagggatgttgaagggttgagaggtatagtatggaagtggggagaaaagtttgagtagaggtttttatttttaatatatatatattgagtgggaaagggatattttttttttttttttttttttttgagatggagttttgtttttgttgtttaggttggagtggaatggtgttattttagtttattgtaatttttgttttttaagtttaagtgatttttttgttttagatttttgaatagtttggattataggtgtttagtattatgtttggttaatttttgtatttttagtagagatggagttttattatgttgtttaggttagttttaaatttttgattttaggggatttatttattttggttttttaaagtgttgggattataggtgtgagttattgtatttggttagggatatttttttttttatataggtatagataggtatttatatatatataaatatatatatatatatatatatatatatatgtatatatatatataaggataaatatgttagtatatagttaaatatatttataggtaatattttttggtatatatatagatatatatatatatatattgtttaaagatatatttttatgtatttttatagttataataagtatgtgtgtaatgaaaaggtatatgtttgttttatatatatattattattaaataggaatatataaagaggtatttaaatatatatataagttgttattttttagtgtatatagaggtttaggtgtattagatatttatagagatttattgtttatagttatatatatatatagatgtatatatatagatgtatatatttaagtagggatatatattgtttttttttttttatttattggggttttttgaggggaatttgtatttatattttttttttttttttttttttttaggggtaagatagattttgtttaggagagattataattaggtaaaggggtttttggtggtaatgtaggggaggggtagaggttaggagtagtaattttgttaggtaggttttggaagtttaatggggttttagtgtatatttggtgtagttttaatttaatgttattttagtatttattgttgtttgtttagagttgagattgaggagagatagaggagaggttgggtttagttgagttgtgaaggtagtgtggtttttgtttgttttaggtttgtttgttttttagtttttttttttattttttatgtgttgtttaggtaatgttaattttttttattttttgtttttttttagggtttagagttttggaggttgttagttttttttgttgttaggtttttgttgggtttttttgttaatttaagatttgttttagataaggaggagggtgtatggaatttttggttttattttttagatttttatgtgttttattttatttgtgtttatgttttttttgtttattgttttttgagttatatgtaaggtttggttgtatatgtgtgttttgttttagattttatgtgtgtttttaggaggttgttatatgatttgttatatgttatatgtgtttttgtttttatgagtatgtggttgtgttaagtatatggtatgggtgtagattggatttgttttttaaatttaggagattattaattatggaaaggagatttagggaatattgttttgaatttgttaggggttttgagttttggatttaggagatttaattttgattatttttttaggatgtagtagggggatgttaaattagattttaggaagaatttttttgttgtttgagttaggtgttgttatgtttgtttaggggtaagaggttagatgggatgaattagggattggaagatgtgggggattggtaatttttgtgtttttggttagggtagaagggggttttgttattttaagaaagagttgttggagttattatggtaattattttttttgggagggttagggtgggtagatggtgattttggaaggaagaaggggtttgtttgggtagttagggggtgtgaggatgtgtgaggtgggggtgtgtggggtttattgtggggaggggtggtgtggattttgtgtggtgttgaaggggatagtgttagatttgttgtattgtgtaggtgtagaggtgtgaataaagaggggagggggatgaggtgtgtggttggaggtggtgtgtgtttatgtggttttatttttgtaggggtttgtttttttagttattttttttttaagtaggttgaggaagaagagatagtaagtttttatttaatttgattttttttttgtttttttttgttgttagtttttttttttttgttgttttgtggggtggggaaatgtggaaggaattttgggaaaattagatgtttgggttttttatttttgtttggtttgattttggataaggggttttttttttagggttttggtttttttatttttaaaatggattgatagtatagatttgtttattttttagaggtgtttgaagttttgatgagataatagatgagaagtggtttttgttgtgatgagttagttgaagtggttgtattggagtgttagattgttagtggtgtagtggtttttgtgttttttatatttttttatatttattttgtggatgatgggggaaggtattatttttggggttttttgaagtggattttgggattgggatttggggatgtggtgagaggtagttttgaagttgagtttagaggtttggggtgttattgttttagggtggatttagttttagattttataattaaatttaaggttagttgagaagtattattattggtgggttgagttgagtttttattttttttaggattttggatttttggaggaaatgaaagggatttagttggaaatatagtttttttttgtgttttttatattttttttttttggtggaaatgtggtttaaattgttatgaagtggaagaggttggatagttttttataattaattaggaatgggaggtttgagtaggtttatttgatgagggaaatattatagttttgttaatttatttattattttaataattatttattgaatatttgttatgtggtagatagtaagagtttggatagtttttttttgttttttaaagttgttaaatgtgattagagggtagaggagaggttggtaatttaagagttttggttttgttttttttgtgtttggttttgtttgttttttttattattattttgtttagaggtggttattggtttaagaggatgatagaagttagtttttgatgtttattgtattttttagttttaggttttaagttttgtagttgagaaggtgaggtttaatgttatattattggtttgttttgtttttgttttggggtttatttgaaaagtttttagattggatttttggtgagatggtatttgattaaataggtttgtttttataggttaaggaggtgggtttggtgtggttattttaaggttaaagtgagaaaattttattgtgtatgtgtaatagatagttgatggagttattgatggagttgtttggaggggagtaagagtttggagttgttaggtattgagtattggaggggttgagagggaagaggaatttgagggaggggagttgagttggggttgggtttgggggttgtttttgggagttggggtgtaggaatataatggaggtggatttgtaggtaatagtggttttgggatgttagtgttaatgtttttttatttgtaggtttttggatttgttttgggaagatgtgttgtttttatatgttttgaattgggttttgttgtgttagttgttttggttgtagtgtgttagttgggttttttggttgttggtgtagttttatttggttgggttgtgttgttttgatgttgtgtaggtgagttgggggttgaagttttgtttttgtttgggtattgttttgtttttagtttagtttttagttttgtagtatgtttttttggatttttttgggttgttggggttgtttggaagggatttatgtattaaagggtaaatatttggtagtgatttagagggaaagtggggttttttttgggagagtaggaggttgttagaaaagaatttaggttaggggtgtataggtggttgaggagtgtgggatgggttgagagttggggtgtttttttgtttgtaggtgggtttgtagattttgtgggttgtattggtttggttgttgtgggatgttgaggggttgtaggagttggtattggtgttgtgttatgaatggttgttagatgaggatttggtgttggtgttggtgtggaatttgtagttgtggagtgtggtgttgggtggttgtgggtaattgagttgttgggtgtttggggttttggttgagggttgtttatgtttgtagtgtttgttgtttgtgtattgtgattgggtggatgggttggtgttgtgtggttttgttgattgttgtttggttttggaggagttggattttattgtttgttgttagtttaaggatgaggttattgtgtatttggtgtagaggtgtggtgttggtttttgtagtttttttttggttgttaatgttaatgtgggggatgttgtggtttaagagttggtttggaattgtttagaattttattattttgattttattggttgtttttgtgttggaagtgatggtgttaggtgtttgggtttgatagggtgggaggagggtagttatttagtttttgttggtatggggtgggttgtagttgttaaaaggttggattgagggttttgaatttttttgtaaattatagtatttttattttgaatagaaagggtttttaggattgtttaggttagagagtttatagtttaaaaattttttttaattaatgtttatatattgggagattttatatagaaagttgatttttggtttttttttaataagggggagattttgtaattttaggtggagttgagggttaggttttttttttaaatgagataggaagtttttagtttattggaagttaatttaggtgttttttttgtgtagggatggaaaaagtatgtttttgttttgagttggagggagattgggattttgttggagttagtttgaggttgagtgagtttgggtttttattttattttattaaaggtgtggtggttttatgtttttagttttattttgttttttttttaggatattggttgagtattgttttgtgttgtgtttgttgtgggtgtggtattgttattatgtggtggagtttagtttgagttgtttgtggaagtgtggtgtggatattgatgtggagttgttgttgtattaggttttggtgttgttgtaggatatggtgggttttgtattttttgttaatttgtaggtttgatttgtttgttaattggagtatagttggattgtgtggttggggtttgatattgagttgtagggaaattgaattgtgaggatttttggtgagaggttagtgttttgttttattttggagttttaaataaagagttttttatttttttttgtttggtgttgttttgttgaagataggggatttgaggttggggaggaaaggttagataggtatagtattttagttttgaggtagaaatgattagaatgtatttatattttttttgggttatttttattgtgtttatggaggtagttttgagagtaggttaatattatggagtaaaggagtagagaagggggataggagttagggggtttttgtgtaggggtatagggtttttgtatttttttgggatttgagtttagaaggtttgggtagagtttggtgagtgttttaatggaagtggtattttttggttggtttgaggttgatgtatgtggtttttatttttttggttttagggttttgtata

SEQ ID NO: 1068 - DNA, 6214 bp, Artificial Sequence
  chemically treated genomic DNA (Homo sapiens)
tgtgtggaattttgaggttgaggagatgaaggttatatatattaattttaagttagttagaaagtattgtttttattgaggtatttgttggattttgtttgagttttttaggtttagattttagagggatgtaggagttttatatttttatataggggttttttaatttttgttttttttttttatttttttgttttatagtgttaatttatttttggagttgtttttatgggtatagtaaaggtggtttaaggaaggtgtgagtgtattttggttatttttgttttaggattgggatattatgtttgtttgattttttttttttaattttgaattttttatttttaatagggtagtattaggtaagagggggtaaaaagttttttatttgaagttttagggtggggtagggtattggttttttattagaggtttttatagtttagtttttttatagtttagtgttaggttttagttatatagtttagttgtgttttgattggtaggtgggttagatttgtaggttgataaaaggtgtgaagtttgttatattttgtagtagtattagggtttggtgtagtggtggttttatgttgatgtttatgttgtgtttttgtaagtggtttaggttggattttgttatatggtggtagtgttgtatttgtagtgaatgtagtatggggtagtatttggttaatgttttgagggaggagtagggtgaggttagggatatgaggttattatatttttggtggggtaaggtggaggtttgggtttatttagttttggattggttttggtaaaattttggtttttttttagtttggggtaggggtatattttttttgtttttatataagggaggtgtttggattggtttttagtgagttggagattttttgttttatttaaggggggaatttggtttttagttttgtttaggattgtaagattttttttttgttgaagaaaagttagaagttgattttttatgtgaaattttttaatgtgtaaatattggttgaaaaaagtttttaaattatgggttttttggtttaggtaattttagaggttttttttgtttagaatgggggtgttgtggtttgtaggaagatttagaatttttagtttggttttttaataattatagtttgttttatattagtagaggttaagtgattgttttttttttgttttattaggtttaggtatttgatattgttgtttttgatgtggaggtagttggtgaggttaaggtggtggagttttgggtagttttgagttaatttttgaattgtggtgttttttatgttggtgttgatggttagagagaggttgtggagattagtgttgtgtttttgtgttaggtatatgatggttttgtttttgagttggtggtaggtggtgagatttagtttttttagggttgggtagtgattagtgaggttgtgtagtgttagtttgtttatttagttatagtgtgtgagtgataggtgttgtaggtgtgggtagtttttggttaaagttttaagtgtttggtgatttagttgtttgtagttgtttaatgttatattttgtagttgtggattttgtgttagtattggtattaggtttttgtttgatagttatttgtgatatggtgttagtgttagtttttgtagttttttggtattttgtagtagttgggttaatgtggtttgtgggatttgtggatttatttgtgggtggggaggtattttaatttttagtttgttttgtattttttagttgtttatgtatttttgatttgagtttttttttggtagttttttgtttttttaggagagattttattttttttttgagttgttattgagtatttgttttttggtgtgtggattttttttgggtagttttggtggtttaagggggtttagaagggtatattgtggggttgggggttgggttagaggtggggtggtatttaggtaggggtggggttttagtttttggtttatttgtgtggtattgaagtgatgtagtttggttaggtgaagttgtattagtgattggaaggtttggttaatgtgttgtagttggagtagttggtgtagtgggatttggtttaggatgtgtgggagtagtatgtttttttagggtaggtttaggaatttgtgagtaaaggggtgttggtattggtgttttggggttattattatttgtgagtttgtttttgttatgtttttgtgttttagtttttaagagtggtttttagatttagttttggtttggttttttttttttaggtttttttttttttttggtttttttggtgtttggtatttgatggttttgggtttttgtttttttttggatggttttattggtggttttattggttgtttattgtgtgtgtgtagtaagatttttttgttttggttttggagtggttgtattaaatttgtttttttggtttgtagagatagatttatttaattgagtgttgttttattgaggatttgatttgaaagttttttgggtggattttgaaatggaggtggaatagattggtggtgtaatattaggttttgtttttttggttatagggtttgaggtttgaagttggagaatgtggtgggtattagagattggtttttgttgtttttttgagttagtagttgtttttgagtgaagtggtggtgggaggagtaggtaaggttaaatgtggagggggtggagttaggatttttaggttattggttttttttttgttttttggttgtgtttagtgattttgaaaaatggggagaaattatttaggtttttattgtttgttatgtagtaggtgtttaataagtaattgttgaaataatgaatgaattggtgaggttataatgttttttttattaagtaaatttgtttaaattttttatttttgattaattatgaagagttatttagttttttttattttgtaatagtttgggttgtgtttttgttgggggagagagatgtagggggtgtgaagaaagattatatttttaattgggttttttttattttttttaaaggtttagagttttaagaagaatgagagtttagtttagtttgttagtggtagtgttttttggttggttttgggtttagttgtagggtttggggttgggtttgttttgggataatgatgttttagatttttggatttagttttagggttgttttttattgtgtttttaggttttagttttaggatttgttttggggaattttaggagtagtgtttttttttattatttatgggatgggtgtggggggatgtgaaggatgtgagagttattgtattgttgatggtttggtgttttggtgtaattgttttagttggtttattataatgaaaattattttttatttgttattttgttaaggttttgggtatttttgaaaggtgggtaggtttatgttattagtttattttaaagatggggaaattgaggttttggagaggaagttttttgtttagaattaagttagatgggaatagagaatttagatatttggtttttttagaattttttttatgtttttttattttgtaaggtagtgagaagggagaagttagtagtggggagagataagaaaggggttaagttaggtgagggtttgttatttttttttttttagtttgtttagggagggggtagttgggaggatagatttttgtaaagatagagttatgtgagtgtgtattatttttggttgtgtgttttgttttttttttttttttgtttgtgtttttgtgtttgtgtagtgtgataaatttggtgttgttttttttagtattatgtggagtttgtgttgtttttttttgtggtgagttttgtgtgtttttgttttgtatgtttttgtgttttttgattgtttgaatagatttttttttttttttgaggttattatttgtttgttttggtttttttaaagagagtagttgttatagtaattttagtggtttttttttaaaatagtagggtttttttttattttggttaagggtataagggttgttggttttttatgttttttggtttttagtttattttgtttaattttttatttttgggtaggtgtgatgatatttaatttaggtagtaaggaagttttttttgaagtttgatttaatatttttttgttgtattttgggagggtggttagggttggattttttgggtttgagatttaaaatttttggtgggtttaagatggtgttttttagattttttttttatagttgatggttttttggatttagggggtgggtttagtttatatttatattgtgtgtttggtgtggttgtgtgtttgtgggggtgggagtgtgtgtggtatgtaataggttatgtggtagttttttagggatatgtgtggggtttggagtgggatatgtgtgtgtagttgggttttatgtgtggtttaaggggtggtgggtgagagagatgtggatataagtggggtggggtatgtgagggtttggggaatagaattaggggttttatgtgtttttttttttgtttggggtgggttttaggttggtgggagagtttagtggggatttagtgataaggggggttggtagtttttggggttttgggttttgggagagggtggggggtgggggggattagtgttgtttgagtggtgtgtagggggtagggggagggattgagaggtgggtgggtttggagtaaatgggagttgtgttgtttttatagtttagttgggtttagttttttttttgtttttttttggttttagttttgggtgagtagtggtgagtattgaggtggtattgagttggggttgtattgggtatgtgttgggattttgttgagtttttggaatttgtttggtagggttgttatttttgatttttgttttttttttgtattgttattagaggtttttttatttggttatggttttttttgggtgggatttgttttatttttggggagagagggagaggagaggaatatgggtgtagattttttttaagagattttagtaggtgggggggaggggatggtgtgtgtttttgtttgagtgtgtatatttgtatgtgtatatttgtatgtgtatgtgattgtgagtagtaggtttttgtgagtgtttgatatatttggatttttgtgtgtattggagaatgatagtttgtgtatatatttgggtatttttttgtgtgtttttgtttgatgatggtgtgtgtgtaaaataagtatgtgtttttttattatatatatatttgttatgattgtgagagtgtatgagggtgtgtttttgagtagtgtgtgtgtgtgtgtgtttgtgtgtgtgttagagggtgttgtttatgaatgtgtttaattgtgtattgatatatttgtttttatgtatgtgtgtgtgtgtgtgtgtgtgtgtgtgtgtgtgtgtgtttgtgtgtgtgtaggtgtttgtttgtatttgtatgaagaaaagaatgtttttggttgggtgtggtggtttatgtttgtaattttaatattttgggaggttaaagtgggtggattttttgaggttaggagtttgaaattagtttggataatatggtgaaattttatttttattaaaaatataaaaattagttaggtatagtgttgagtgtttgtaatttaagttatttaggagtttgaggtaggagaattatttgaatttgggaggtggaggttgtagtgagttgagatagtgttattttattttagtttgggtagtaggggtgaaattttattttaaaaaaaaaaaaaaaaaagaagaatgttttttttttatttagtatgtatatattgggggtaggagtttttgtttaggtttttttttttatttttatgttgtgttttttagttttttagtatttttatataatatttgttttttttttttttttttttaggaggtttgagttttttttttttgagtgaggggtttttataagagagattataggggttatagggttgtatgatggtgatagttggttgatattttttttttagagggtggggtattaattttttttattttagaagtagttttaaagtgttataagaattttgggtttatttaattttgaagttgttttttttttttttttagggtgatgtttagggttttaggtagaaggaaaggagttaggggtttattgggtgtataagtttttttttgttag

SEQ ID NO: 1069 - DNA, 6323 bp, Artificial Sequence
  chemically treated genomic DNA (Homo sapiens)
tgtgtaggtgattggggtgaagagaggttggtgaaatgggtatgagtatgtgggtagatggaaggaatatgttttaaagttttatggtagattagggtgattagaggtaataatgatgtattagagtgtgtttttaaagagttggaagatagtatatgagttgtttttaataggtagagatgatagatatttattggatggatatttatagatattgtataattttttagttgattatggattattatgtaatgtataagtattattatatgttataggaattttattaatattatgtttgtatgaagaaaaatatagttatgttataagagtgattgttatagttttttttttttagtgttatagtttgtggttttggttttttaagttttgttgttatttttattaaagttgttgatatttgtggagtttaattagggattttgtgtttagggtttggtatgttttggaaaagttagtgagtttgttggtatgagtggttttggtgggtggtttaattattaggtgtagattttttttagttgagagagaagtggttttttagttatttggtttggattggtggaagttgttttgttttatattattggagtattttgtggttagaagagagtgtgagggtgttgttggtggtggtggtgggttatttggtgataatttgaggagaaagtttgatttggttagtgggtttggttgttgagaaatagtggtagtgaggtgagtatatgataaggaagagttgtaaagttgatgttgtgaaggtggtgttagttaggttaaaaggatagatgggtggaggtaggtagtatattttttaaatattgtaagtttttttttttggtgtataggtatgtagttataggttaagttgtgatgtgagttttgtgtgtgggatttttgtaaaaggtttgtttgatgtgttgggtgggaattgagtttgggttaattgtttggaaggtaattatgtttattattatattattaatgttgtatggtgtgggtagttttgttgtgttggtttggggtttttattagtgtgttgttgatgtttggggtaggttggttttgatgtttggtttgtttgtttgtttgtagttttgtgttgttgtggtttttttaaaggttgttttgtgttttattggtgtaaggttagtgtggttgatttgttatgtttgtttgtttttgggggtgtttttgtttatttgttgttttgggtttttagagtttttttttaataggtgtttgggggggaaatggttggtgttggtagggtttttatttttatgttttttattgggtgtagggttttgtgtgttgtagaaagttttttttgataattattttgagttggtagtttgttgggtgttgtgtagggttagaggaggttttttggttgttgttattaagttgtggatgagaagaaaagataggaggttaaggaggtttagaaggttaaagggttaggtaggttaggtttgagatggtattttgtgattagttggagggtggaggaaggagaaggagggtttataggttgggtttgaggtggtggtttaaaaagtatggttgtttttttgttggggaattgaattttggttttttgtgtgataggtggggatatttattattatattaatgaggatgatggtgatggttgttgggatgttagattttattttgattgtggatgtttagttttgttttgatttttttttttgatggtaggggttgggtgtgtgtttgttttttatttgttgtttgttgtttgttatttgttatatgttatttgttatttgttatttgttttttgttattgttggtatgatttattttgatatttaataaagtattttgtgattttgttgggatttggagttggagttggattttgataggtattggagtggtgtggaatttttttgtgtgttttgtttgttgtttttaatgtggggattgtgttggggtaggaggaggtgtgggtgaaatagttaggttgttgtttttaggatgtggtgggtgtatgttttgtggggtttggtgagtggaggtgtgggggttggggtgtgtgttggtggtggttggtttgatgtggattttttgggtttggggtggggatgtgggggtgtttatgttaatgttagttggttttgtttatttggtgtttgttttttttgtgtggtttgttggttgtgtattgaatttagataggtgttggttaagggtgtaggtgtttgtgttgggttttagttatgttagtggtgaagtgttttggtgtgttgttaggatggttgagtggtttaaggtgttgtgtttaggttgtagttttttttggaggtgtgggtttgaattttatttttgataagttgattttttggtttgtttgttggagggtaatgtttatggtaattttggagtatttttggttgttttttgttttgagtttttgtttgttttttagattttagtttttttgaagtaagtttttaaaatgttgttgttttttaggtatgtttgttttttttgtttatttgttggttgttgtagaaatagtttaggattatgtgttagtgtttgtgattttttattaattgttttttggatagatgttttttttattattttatatgtttttttttttggttttatatatagtgagtgattgtgattattttttatgtttttttttgtttattttttttgtttgttttttttttatttgtttaaatagatatagtttagattttttttttatttttttttttttttttttttttttattggtttttgtttattgtttattgttttgaattgttgttgtgttgtttagaggtgttttggtttgaatagtttgtttggttttattttttaatttttgattgttgagtagtagtgagtgatttgtttgtggagttgtatatatgttttttattagaggtatgttatttaatattttgtttttttttttgattttttggattttggttgtgtattttattttgttgatattttagttaggttgttgattttattttgttatttgtgttttttttttgttaatatttgtttgttggtttatttgtagtttggatgtttgttggttagaggtagtgggaattttgtatatagttgggtaggtgagtttaaatttggaaagatagtttaagaggaattatgagtggaagttttagatttttgttatttgtttataaatgtttggttttgttgggattagttttgtgttatagtgtatttttatgtgggaagttgtggtttgggttgttttagttatatttagtgtgttttttttagggttagttagttgtggttttgttgaagtgtttttttgttttttttttgtgttttagtttttttattagtttagggggttggattttaagtgtgagttggtggtgtgggttagagtgtaggagtgaggtgtttatggatttggtttgtgtttttgagttgtatgttatggttgtgagatttgttttttattgttgtttttgtttgttgatatatttattttgttttttatttgttggtgatataagtgagaaggttggttttatggtggtgaaaaaaaaaaatattatatgaaagaaagaaagaaagaaagaaagaaagaaagaaagaaagaaagaatttttgtttgttatgtgggaggtttgggtttgatttttggtttatgtagtatgtttttttattttggtgttgtagtagtattaaggtgtagttgtgtttgtttttgttgtttttttatatttggggtgtgtgagtgagtttggtattggttgtgtttttatgtgtgatggttttttgtttttttttttgtgttttttttgattgatttagggatgagtttattttatgtatttatatattttggtgataataatttttttagatatgagagtgtgttagatattagaatttggtagttttttggttttgtttttttttattgttttgttattgtttttgtttgatgtattttattttatggaatattgttaggtattatgggtttgtagttatttgtattattttttttttttatattttattgttttgatttttttttttttttttttttttgtttttttttttttttttttttgttggttttttatatttagaaaatgatgttatggttgtttttttagtaggaaggaagttgtgattttagggagtaatttattatttttttttagttggttatatagtttttaatgtgattatatgagtgtatgtgtggtatgtgtattgtttatatttattgtgttttggttattttatattttttttttttattttgttggtattattattgttatgttgtaatttttaatttaattttaatttattattttagttgaggatgttgttttgttttttttttttggatttttttttattttagttttagatatatgtttgagatgtgaatgtgtgttttgaagatggtttatttatgttttgggtttagttgtattttttatttttttgggatgtgggatgtggtttttagttgttttgttatgatgttttttttattttgggttgtttgttattttattttagttttattttatattttgattgtttagtttaagtagtattttagttttgttggtgtgggttttttttgattatatagattttgtttttgtttagattaattggttgaaaatgtattgtttttattagtttttaggtttagtttttttttttttatttttgttttatgttatttatttttttatttatatatatattttgatgtgtatatatatatatatatatatatttttatttttttttttttttattttttgtttttttttgtttttttttttttttttgtttttatgtttttatttttttgtttttgttttatatagttaattttttgttttgttgttaatgttttttttttagatgatttatattttttagttttggttttttttagtttttttagatttatgttagttttgttattagttgggatttttttgatttatggtataggtagtttgtgaggtgttttaatgttttaggtatttgtataatttttgtttgattgtatagttttatttttagatttggttagttagttttgtgtattttttggatattttggatttttttttttagtttttagtatgtgatatgttttttttttttttttggtgttagttttttgttttgggttagggtggatgttagttatgggattggatatttttttttgttgttgttatttattgatatttatttataatatgttggtaagtaagttagttttttgtggggatggtaaatatttttatttttgatagggtttggtttttgtaggtgatttgattgtgttaagattttatgaatgatatgggataggtttgtgtagttggttggatgtttattttgtttttatagaggggttttggtaagaagttgattgatttttgttattgatttggggaattagttaaataataagattagtatgggttgaatagagggttgtagaattgggtttatttgtgttaaggaggggaggggaaaaaaagttttatagtgaattttggtgttggggataggtattatttttatatgttttttgatatttggagagatgatagagagtgtaggttaggtaatgggaagtaaattttggttagaagtttgttaggaattttaattttgtatatgtgttttggttagtttggttgttgggttttttttatgaattgttgtatttttatgttttaatgtttgtggttaggttggtttgattaatgggattttttaagatttatttttatatttagaataggtgagaattttaaatttgttgatggtgagtgggagtatgtgtatgtatatgtatgtgtatgttgtgggaagttagggattttgaatggagggagtggttggagttgtggttgaggtatgtaaattgtgaggattttattttaatatggatatttattagtttttaaataatgtttttataattttttatgtttgtttttattttaattttttaattttgttatttttgtaagttgaggatgtatgttattttaggattgttgtgataattgtgttgattttataaattgatggtaaaatgtgtgtgtttgaatagtatgaaattagggtattttgaaaaagaatagaataatagtgatttttagggaataggggaagataatggtaaggtttgattgtttgtgaggttgggtagaaagagttatatttttttttttgtagagagtttatgaaggatgtgt

SEQ ID NO: 1070 - DNA, 6323 bp, Artificial Sequence
  chemically treated genomic DNA (Homo sapiens)
gtatgttttttataggttttttgtaagaagaaaaatatggttttttttgtttgattttgtaggtagttagattttattgttgtttttttttgttttttaaaagttgttgttattttatttttttttaaggtgttttgattttatgttgtttaaatatatatgttttattattaatttgtagagttaatataattgttatagtggttttgaggtgatgtatatttttagtttatgaagataataggattaagagattaaagtaaagataggtgtaagaaattataaaagtattatttgggaattgatgaatgtttgtattgaaatgaaatttttataatttatgtgttttggttgtagttttagttgttttttttgtttggggtttttgattttttgtaatgtatatgtgtatgtgtgtatatatgtttttgtttattgttgataggtttgagatttttgtttattttggatgtgaaaatgaattttgagaggttttattagttagattaatttggttatgggtattgaagtgtggagatgtagtagtttgtggggaaaatttaatggttaggttgattaaagtgtatgtgtggggttggggtttttgatagatttttagttgaagtttgttttttattgtttgatttatgttttttattgtttttttaaatgttaaggaatatgtggagatggtatttatttttagtgttaagatttgttgtgggattttttttttttttttttttttagtatagatgagtttagttttataattttttatttaatttgtattgattttattgtttggttgattttttaggttaatggtagaagttagttgattttttgttaaaatttttttgtaggggtaaagtagatgtttaattaattgtataaatttgttttgtgttatttgtgggattttggtatagttggattatttgtagggattagattttattggggatagagatgtttgttatttttatgggaggttggtttgtttgttagtgtgttgtgggtggatgttagtgggtgatagtgatggaagaaggtgtttgattttgtggttggtgtttattttagtttggggtaaggggttgatattaaggaaaggagagaagtatgttgtgtgttgggagttggaagaaggagtttagggtgtttagggggtgtatagggttggttggttaggtttgggagtgaggttgtgtagttaaatggaggttgtgtagatgtttggggtgttagggtattttgtgggttgtttatgttataggttggagggattttagttggtggtggagttggtgtgagtttgaagaggttgaaggaggttagggttgggggatatgagttgtttgagagaggggtattgatggtgagatggagagttggttgtgtgagatagagatagagagatagagatatagagatagagagagagagagagatagagaaagatagagagtgagagagagagagagtgagagtgtgtgtgtgtgtgtgtgtgtgtgtgttagagtgtgtgtgtgagtgaaggggtgggtggtgtgagataaaggtgggggagggagggttgagtttgaaggttggtgggaatagtatatttttagttggttggtttgggtaggaatgaagtttgtgtggttaaaggggatttgtgttggtgagattgggatgttgtttgggttgggtggttagagtatggagtggggttggggtgaggtggtaagtagtttagggtgggagagatattgtgatagagtgattggaggttatgttttatgttttaaaagggtagggaatgtaattggatttgagatataaataagttgtttttaggatgtatatttatgttttaggtatgtgtttggggttgagatgaaaagaggtttgagggggagaaataaggtagtatttttgattaaagtggtggattggggttaggttgggagttgtgatatggtggtggtggtgttggtagaatgaggggagagagtgtggagtagttggaatatggtgaatatagatggtgtatatgttatgtgtatatttgtgtggttgtgttaaggattgtgtgattaattaggggaaagtgatgagttattttttggagttgtgattttttttttattggaagggtaattatggtattattttttggatgtggggagttagtgaggggggggggggagagagatagagagagagagagagagagaggttgaggtggtgaaatgtgaagagaaggggtggtgtgagtggttgtaagtttgtggtgtttggtggtgttttgtgaagtgaaatgtgttgggtagaggtggtggtagggtaatgaagagaaataggattaggaggttgttaagttttggtgtttggtgtgtttttgtgtttggaggggttgttgttattaaggtgtgtgggtgtgtggggtaggtttatttttaagttagttgagagaggtatggaagaaagggtagagggttgttgtgtgtgggagtgtagttggtgttggatttgtttgtgtgttttgagtgtaaggaggtggtagaggtgagtgtagttatgttttggtgttgttgtagtattaaaatgggagggtgtgttgtatgggttgggaattgaatttgggttttttgtgtggtaggtgagaatttttttttttttttttttttttttttttttttttttttttttttttgtgtggtgttttttttttttattattgtggggttagtttttttatttgtgttattagtaggtgagaggtgggatgggtgtgttagtgagtgggggtggtgatggggaatgggttttgtagttgtggtgtgtggtttagaaatgtagattaggtttgtgggtgttttgtttttgtgttttgatttatgttattggtttgtatttggggtttggttttttgggttggtagggaggttggagtgtgagaaaggagtggaggagtgttttggtagagttgtagttggttgattttggagaaggtgtgttgggtgtggttgggatggtttaggttgtggttttttgtgtggggatgtgttgtggtgtagagttggttttggtggggttaggtgtttgtgggtgggtgatggggatttagggtttttgtttgtgattttttttgggttgtttttttgggtttggatttgtttgtttggttgtgtgtagggtttttgttgtttttggttggtaggtgtttgggttgtaggtgggttggtaggtaggtgttagtgggaagggagtataggtagtgaggtgggattggtgatttggttagggtgttggtagaatggaatgtgtggttggggtttgaggggttggaggaaaggataggatgttggatggtgtgtttttggtgggagatgtgtgtgtggttttatgagtgagttgtttgttgttgtttagtggttagaagttggagggtgaaattgggtgggttgtttaggttaggatgtttttgggtagtgtagtggtgatttaaggtggtgggtggtgggtggaggttggtgggaggaaggagggaaaaggaggaataggggaagaatttgggttgtgtttgtttgggtgagtgaggagaaggtgggtggaggagataggtagggaagagtgtggaaggtggttgtggttgtttgttgtgtgtggggttagggaagagggtgtgtgaggtggtggggagggtgtttgtttgaagggtaattggtagagggttgtgggtgttggtgtatggttttgggttgtttttgtgatagttggtgggtgggtaggaagaatggatgtgtttgagaagtggtggtgttttggaggtttgttttaagggggttggagtttggagagtgggtaagggtttaaggtaggaagtggttaaaggtgttttagggttgttatgggtgttgttttttggtgggtgggttaaaaggttggtttgttaggagtgggatttgaatttatgtttttaggggagattgtgatttgaatgtagtgttttagattgtttggttattttgatggtgtgttggggtgttttgttgttggtatggttgggatttggtgtgaatgtttgtgtttttggttggtgtttgtttgggtttggtgtgtaattgatggattgtgtggggggagtgggtgttaagtgaatggagttggttggtgttggtgtggatgtttttgtgtttttattttggatttaaagggtttgtgttgggttggttgttgttggtgtatgttttagtttttgtgtttttgtttgttgaattttgtagggtgtgtgtttattgtgttttaggagtagtggtttgattgttttgtttgtgtttttttttgttttggtgtgatttttgtgttggagatagtaggtagggtgtgtggggaggttttatgttgttttggtatttgttggggtttggttttggttttgggttttagtgggattgtagggtgttttgttgggtgttggggtaggttgtgttaatggtggtggggggtgggtggtaggtgatgggtggtgtgtggtgggtggtgggtggtgggtggtgggtggaaggtgagtatgtgtttggtttttgttgttgggggaggggattaaggtagggttaggtgtttgtggttggagtggggtttggtgttttggtgattgttgttgttgtttttgttagtatagtggtgagtatttttgtttgttatgtgggagattggggtttgattttttgatggggaggtagttgtgttttttgggttgttgttttggatttagtttgtgggtttttttttttttttttttgttttttagttagttgtagggtgttattttgggtttggtttgtttggttttttggttttttgggtttttttggttttttgttttttttttttgtttgtggtttggtagtggtagttgggaggttttttttggttttgtatggtgtttaatgagttgttggtttaaagtggttgttggaagaggttttttgtgatatatggggttttgtgtttggtgggaagtgtaggagtggggattttgttggtgttggttgttttttttttgggtatttgttggggaagggttttgggggtttgaggtggtgagtgagtgagagtgtttttagaggtaggtgggtgtaatgggttagttgtgttggttttgtattggtggggtgtggggtggtttttggagaggttgtggtagtgtggagttgtgggtgggtggatggattgggtgttggggttggtttgttttgggtgttggtggtgtgttggtgggagttttgggttggtgtggtggggttgtttgtgttgtgtggtgttggtggtatagtggtgagtatagttgttttttaagtagttgatttgggtttgatttttgtttaatgtattgggtggattttttgtggagattttgtgtgtggagtttgtgttgtagtttggtttgtggttgtgtgtttgtgtgttggggaaggaggtttgtggtgtttggagggtgtgttatttatttttatttatttgtttttttggtttggttgatgttatttttgtaatattggttttgtagtttttttttgttatgtgtttattttgttgttattgttttttagtggttaagtttattggttaggttaggttttttttttggattgttgttaggtgatttattattattattagtagtatttttgtatttttttttggttatggaatgttttagtagtgtggagtagagtggtttttgttagtttaagttgggtggttgaggggttattttttttttggttgagggggatttatgtttaatgattgggttatttgttagagttatttatgttagtaagtttattggtttttttaaggtatgttagattttgagtgtgggatttttgattgggttttatgggtgttagtggttttggtagaaatggtagtagaatttgaggagttgagattatgggttatggtgttggggagggagagttgtgataattatttttgtagtatgattatgtttttttttatgtagatatgatattggtgggatttttgtgatatgtggtgatgtttgtatattgtgtaatgatttatgattaattgaggggttgtatagtatttgtgggtatttatttagtgggtatttgttatttttatttgttggaaataatttatgtgttgttttttagttttttggaaatatattttaatatattgttgttatttttagttgttttagtttgttatagaattttagaatgtattttttttatttatttatatgtttatatttattttgttaatttttttttattttagttatttatata

SEQ ID NO: 1071 - DNA, 6518 bp, Artificial Sequence
  chemically treated genomic DNA (Homo sapiens)
tataaaatggagagaattttaatgtttattttataggattatattaggaggtttaaatgagatatgatttttaagttatttagaagagtatttgatagtgttatgtaattgttagttagtattttaagtttttgagggaaggggaagttggaaggagaagatgtttgggattatggaggttatgattttaataattggtatagattagaattttgttataattattagaggtttttagtgttaagttttaggggaagaaattttgatttgattattatgatatttttaatagttgtgggaatagtttgtgtagatggagtatggttatagtaaataggtgttgaatgaatttataaattgttgtgttagttattttttgaaggagttttagaattgaatggttagaagaatttgtgaggaagtaaagggagatttatttttttatttatgtttggttttaaagagaaatgaggtggtaggtagagggtaaggatttgttagaggaaatagttttagagtttagggatgaggagggggtgtttaggattgtgtggattgttatattatttttaggtggatttttttagttgtatttagttgggaatttttgggtttttgggatttagtttagaaaattgttttttttgggatttattttgtttatttttttgatggttagatagtggattaaagggagtaggaattgtttttgggttgtttttatattttagtgtttaatattatagttggggtttaatttagttttgtggaataagtgtttttaaagatttttatgttttttatttttttgaatttaatttaaatgtttttttttttttgaagtttttttagttattttagttagtgtatttggtatttatgtttattgttttgtgatttatattagttgtggatgaataatattattgtatttttagtattttatataatgttaggtatatagtaggtgtttaattaatgtaaatgaataatttaatgtttttttagtaatagtaattaatttatttagttattttttttgttggtattttaagagatatagaagaagttaagattattatttatgtattaattagatattattgaggggtttttttttttagttttattttggtgtatttgttagagtatttatagattttttatttatattggtttgtttttttattggttttttattttatttttgaggtatgagaagattaatagtttggtaaagttatggggtttttagattagttggagggggttgtgttgatgtgtgtatatatagagggtttagggtttttgggggtttttttgttttttaattttgtgtagaatattttatttagtgggaaagtgagttaagtttttggtgttaattaggaagtgatgaggatgtggtgattttattgatttatttagtattgatttttaatgtatggtttttagtttgagttgatattttatttattttggtttttttagtatttaagtttatttttttgttaggtgatttttttggagtattgattggggttgtaggtgttttgttttgttgtttttggagtttgtttttggggagtgggggtggttgtaattattagttgtgaggagaggattgtattttttttttttggttggtatttgaatagagttagtttttatttttgtagtggtgaagtgtttataaagtttgtgttgtgttgttgatttagagttgggtaggaagtggggaagagggggtggaggagataaaggggttggtgttttgtttagttaagttttggtttttggtttgatttttttattttttgtatatttttggtgaggttaggaggtttatttggtgttgtgtatttttgtttgtagtttttgttttatgtggtataggtgtgggggtggggtgttatggaggtttaggtgtgggtggtggggttggggtagtatgggtttttggattgttgttttttggtgttggtaatttttttatgtgttatttaggaagtaaataatattatgaggagtgattttttttttttttttttttttttgagatggagtttttttttgttgtttaggttggagtgtagtggtgtgattttggtttattgtaatttttgttttttggatttaagttatttttttgttttagttttttgagtagttaggattataggtgtatgttgttatgtttggttaattttgtgtatttttagtagatatggggttttattatgttggttaggttggttttgaatttttgatttgaggtgatttatttgttttggttttttaaagtgttgggattataggtgagagttattgtgtttggttgattttttgatttttattatatgttaggtattgtgatagattttttttgtgtattattttattttttttttagttttatagaagaggaaattgagatatattgaggattaaggttaagtgtttgaagtattatagttggttagtgttaggatttaagtttagaatttgtgttttgttaggtatttgtaaatggggatgaatatggtgtagttagaggggttgataggttagggagaaaattattggtagttgtgggtattttatgttttgggagtgaggtggtaagggataagttttttgttttttagatttgttttgtaaatatttgtgggttgagggtgtgaaggtagtaggatgtagtgatagatttggattaggtggtttaggttttatttttaagtgggttattgataggtggggtggtttttagtataaaattattaggttggatgttttagggttttttaatattatttgtttagaagaattatttggggagttttttaatgagaaagatttttaagttttttttttagagagtgaagttattgggattgggttgggtttagttaggtgttattaataataagataagtttggaaaattttgtgagtgtagatgattttttggtatgttttttataagaattgatttttatattaaaataggttttttttaatttagtgaaattgggtgtgtttttttggtttataattaagttattgaaggttttagaatattttatttttaaaaggttatgtgaggttggtgtggtagtttatgtttgtaattttagtattttgtgaggttgaggttgtggattgtttgagtttaggtgtttgagattagtttggttaatatggtgaaatttggtttttattaaaaatataaaaattagtggggtgtggtggtgtttgtttgtaattttagttattttggaggttgaggtgggaggattgtttgagtttgggaggtggaggttgtagtgaattgagattgtgttattgtattttagtttgtgaaatggagtaagattttgtatttaaaaaaaaaaaaaaaaagttatgtgagttggggttattggaggtgttttttaattgattgggttttggaaaattaaggggtgtatgttgttttgttttgttttgttttgtgattataagttttattgtgttttgtgtttgtgtatattatgttagaataagatggttgatgtggtggttatagttggggttggtggttttggaatggtaagggtaggaagtgtgggtttggagttgagagagtttgggtattttgtaattttttttttgattgagtaataagataatgtttagaaatttagttttattatgagttttgattggtggagggtgtttttaggttgtaggtgttttttttttgggatttggttgtggtttttggagttggtggatttgtgttttgattggtttgtttgttgttgggggttgggagtttggaatatttttgattggtttgaagatgttgtttttgtttttttattggttggttaaagttgaaaggtatttttgttttaaaatatttagtttttttatttttttgtgtttttattttttgtttttttttttttgtggttattttttgttattgtttttatttttttttttaatgaaatggtgtgaagatgggaggtataagagagggattttgttttttttgtgggatatgttttaattttattatgtgtgtttttttagttatgtattttaataatttgttaaagtagaaagtaaaagatttgttattttattttattgggattgtatgttttaggtaagtggagaagtggtttttgtatttaaagtattttgggtgtttaatttttatttagttggttaagatttgtaaatttaaatattaagtattgatttttaaaataaaattatttagtaaaataattttgtttgttgttgattatgtatgaattatgtgattgtattttttttttgtggatgaaaatttttttgttgatttatagagattgggaagtaaatagtttattaattttgttgataattattatttggtttggaggagaattttgtaggtggttgtgagttttttgttgatagaggtagggtttgagagtgttgagaaagtatttgtggaaatgttgatagagatgttgtagagttgtgagtatatggaaatatttggttttggagttaattttaatattagttttgtgttttgttttgtgatagtgtttgagaggatttaagaaataaattttttttttaagaggggagaaaaaaaattttttttaatgtaaaaagttgagaaaagaaaatagtataatgggttgagtgtggtggtttatgtttgtaattttagtattttaggaggttgaggtgggtggattatttgaagttaggagtttaagattagtttggttaatgtggtgaaattttgtttttattaaaaaatatataaaaaaattagttgggtgtggtggtaggtgtttataattttagttatttgggagattgaggtaggagaattgtttgaatttgggaggtagaggttatagtgaattgagattgtattattgtattttagtttgtgaggttttatttttaataataataataaaaatagaaaagagtataatgaagtgatttataggttttagaattagatagatttggtgtatattattattttgttatttaatagtttgggtaagttattgaattttttgaattttaatttttttatttttgaaatgggataatagtttttattttatggatttgtgagtgtaagtgagatgtatatataaaatatttagtgttggggagattttaagtttttggtgagttatgggtgtttttaaggatttttgttggggagttaggattaattttttatgtaatagatattattatattatgtaatgaaatgttagattgtgtgatataaagaatgaaggggaaaagttttttttttttttttttttttgagatagagttttattgtgttgtttaggttggggtgtagtggtataattttagtttattgtagtttttgttttttaggtttaagtaatttttttgttatagttttttaagtagttgggattataggtgtgtattattatgtttggttaatttttgtatttttagtagagatagggttttattatgttggttaggttggttttgaatttttgattttaggtgatttatttattttggttttttaaagtgttgggattataggtatgagttattatatttagttgaaaagttatttttaaaaggaaatgtgttgagatttagaagtttgggtgtggttttatagaggtttttttgtatgtataatatatttttttgttttgaatttttggggtatgggatgggatgagggatggaagtatttatggtgttttttagggattaataattatgaaaggaagtaggagaaaggtttgggtagagggagatgtggggtgtaatgtaggtttaataaagaagtggataatttagttaggatttttggagtattattgtttattaagttgaaaaggttttgtttttatatttaggttttgattaaatagtagatgtgggttattttaggaagggtgattttgggtaaggtggttttttgtagttgatatttggtatttttaaatattaaatgtttttttaaagtagtgattttaattattgtggttttagaatttttatatttatttatttttattaattagagatggggttttgttgtgttgtttaggttggttttaaatttttggatttaagttttttatatagttgggattataggtatgtgttattatatttagtttttagaatttttttatattaataaatattgaggattttaagtagtttttgtatatgtgtatttgttatgttagaaaaaataaattttgggtttaggtgtggtggtttatgtttgtaattttagtattttgggaggttgaggtgggtatattgtttgaggttaggagttttaagattaattttgttaatatattgaaattttgtttttattaaaaatgtaaaaaattagttggatgtggtggtgggtgtttgtaattatagttatttgggaggttgaggtaggagaattgtttgaatttaggtggtagagattgtattgagtta

SEQ ID NO: 1072 - DNA, 6518 bp, Artificial Sequence
  chemically treated genomic DNA (Homo sapiens)
tggtttaatgtaatttttgttatttgggtttaagtgatttttttgttttagttttttgagtagttgtaattataggtgtttgttattatatttagttaattttttgtatttttagtagagatagggttttagtatgttggtaaggttggttttgaaatttttgattttaggtgatatatttgttttggttttttaaagtgttgggattataggtgtgagttattatatttagatttaaaatttgttttttttaatgtggtaaatatatatatataaaagttatttggggtttttaatgtttattaatataaagggattttgagagttgggtgtggtggtatatgtttgtagttttagttatgtgggaggtttgggtttagaagtttgaggttagtttgggtaatatagtaagattttatttttaattaataagaataaataaatataggagttttgaagttataatgattgagattattgttttaggaaaatatttggtatttaaaagtgttaaatattagttgtagagagttattttgtttaagattattttttttggggtagtttatatttattgtttgattaagatttgagtataaaggtagggtttttttagtttgatgggtaataatgttttaggggttttggttaagttgtttatttttttattgggtttgtattgtattttatatttttttttgtttaaattttttttttatttttttttatagttgttgatttttaagaaatattgtaaatatttttattttttattttattttatgttttaaaagtttaaaatagggaaatatgttgtatatgtagaaaagtttttgtaagattatatttgggtttttaaattttaatatatttttttttaaaagtagttttttagttgggtgtagtggtttatgtttgtaattttagtattttgagaggttaaggtgggtggattatttgaggttaggagtttaagattagtttggttaatatggtgaaattttgtttttattaaaaatataaaaattagttaggtgtggtggtgtatgtttatgattttagttatttgggaggttgtggtaggagaattgtttgaatttgggaggtggaggttgtagtgagttgagattgtgttattgtattttagtttgggtaatatagtgagattttgttttaaaaaaaaaaagggggggggggttttttttttttattttttgtattatataatttagtattttattatataatgtgatgatatttattgtatggggaattagttttgattttttaataaaagtttttaagggtatttataatttattaagagtttaaaatttttttagtattgaatgttttatatatatattttatttatatttataaatttatgaggtagaaattgttattttattttagaaatgaggaaattgaggtttaggagatttagtggtttgtttaagttattaagtgatagagtgatgatgtatattaagtttatttgattttaaagtttgtaagttattttattatgtttttttttgtttttgttgttgttgttggagatggagttttataggttggagtgtagtggtgtgattttagtttattgtaatttttgttttttagatttaagtgatttttttgttttagttttttgagtggttgggattatagatatttgttattatgtttagttaatttttttgtgtgttttttagtagagatggggttttgttatgttggttaggttggttttgaatttttgattttaggtgatttatttgttttagttttttaaagtattgggattataggtgtgagttattatgtttggtttattgtgttgttttttttttttaattttttatattaaaaaaaattttttttttttttttttaagaaaaaagtttgttttttaaatttttttaaatattattataaagtagggtatagaattgatgttggggttgattttaaggttaagtgtttttatgtatttatagttttgtagtatttttgttagtgtttttatggatgtttttttggtatttttaaattttgtttttgttagtaaggagtttataattatttgtagggtttttttttgggttagatgatagttattggtagggttagtggattgtttattttttgatttttgtgaattagtagagagatttttatttataggagaaggatgtaattatatagtttatatgtggttaatggtaagtaaagttattttattaaataattttattttaaaaattagtgtttaatgtttagatttatagattttggttaattgagtaaaaattgagtatttaaggtgttttaaatatagagattatttttttgtttatttaaaatgtatagttttaatgagataaaatagtaggttttttattttttattttagtagattattagaatatatagttgaagaaatatgtatgatgggattaagatgtgttttgtagaaaaaataggattttttttttgtgttttttatttttatattattttattgaaagggaaaatgaaaatagtaataagaggtgattgtgaggagaggagggtaaaagataaaagtataaaaaagtaagaaagttaaatattttgaaatgggaatgttttttaattttggttggttaataagaaggtgaaaatggtatttttagattaattgggggtgttttgggtttttaatttttaatagtgaatgagttaattaagatataggtttgttaattttggaggttgtagttaagttttaaggagggggtgtttatggtttgaaaatattttttgttagttggagtttatgatggggttgaatttttgggtattattttgttgtttagttgaggggaaagttgtaggatatttaaatttttttggttttgagtttgtgttttttgtttttattgttttggagttattggttttagttgtggttgttgtgttggttattttgttttggtgtagtgtgtgtgagtgtggggtgtgatgggatttgtagttgtggggtggggtggggtggggtggtgtgtgttttttggttttttgaagtttagttggttgggggatgtttttggtgattttggtttatgtgattttttttttttttttttggatatagagttttgttttgttttataggttagagtgtaatggtgtgattttggtttattgtaatttttattttttaggtttaagtgatttttttgttttagtttttggagtagttgggattataggtgggtattattatgttttgttagtttttgtatttttagtagagattgagttttgttatgttggttaggttggttttgaatatttaagtttaagtagtttgtggttttggttttataaggtgttgggattataggtgtgagttattgtgttagttttatgtgattttttgagagtgaagtgttttggggtttttagtggtttggttgtgggttaggaaaatgtgtttggttttattgagttaaaagaaatttattttaatatgaaaattggtttttataaagagtatattaggagattatttatatttgtagggttttttaaatttgttttattattagtaatatttggttgggtttagtttaattttagtgattttattttttggaagaggggtttgggaattttttttattaaggagttttttagatgatttttttgagtgagtaatgttgggaaattttggagtatttagtttggtgattttgtgttgagggttgttttgtttgttaatggtttatttggaagtagagtttggattatttagtttaagtttattgttgtattttgttgtttttgtgtttttgatttgtaagtatttgtgaggtaagtttagggggtgggagatttgttttttgttgttttatttttagggtgtggggtgtttgtggttattagtggttttttttttagtttgttagtttttttagttgtgttgtgtttgtttttatttgtaggtgtttggtaggatgtagattttgggtttggattttaatattagttagttatggtattttgggtatttgattttaatttttagtgtgttttagtttttttttttgtaaagttgggggaaagatgagatgatatatagaaagagtttgttatagtgtttgatgtgtagtaagagttaagaaattggttgggtgtggtggtttttgtttgtaattttagtattttgagaggttgaggtgggtggattattttaggttaggagtttgagattagtttgattaatatggtgaaattttgtgtttattaaaaatatataaaattagttgggtgtggtggtgtgtgtttgtagttttagttatttgggaggttgaggtaggagaatagtttgaatttgggaggtggaggttgtagtgagttgagattgtgttattgtattttagtttgggtgatagagggagattttattttaaaaaaaagaaaaagaaaaagaagttgttttttatgatgttgtttattttttggatagtatgtggaggagttgttaatgttgggaggtagtggtttgggaatttgtgttgttttggttttgttgtttatatttgagtttttgtggtgttttgtttttgtatttatgttgtgtggggtgggggttgtgggtgggggtgtgtggtgttggatgagttttttggttttgttgagggtgtatagggggtgggagagttaggttggggattgaaatttggttgagtagagtattagtttttttgttttttttgtttttttttttttattttttgtttagttttggattggtggtgtggtgtggattttgtaaatattttgttattgtaggggtggagattggttttgtttggatgttggttgggggggagaggtgtaattttttttttgtggttggtggttgtgattatttttattttttaaaggtaggttttggaggtggtgggatagagtgtttgtgattttagttggtgttttggggaggttatttgatgaggaggtaggtttgggtgttggagaaattggggtagatgggatgttagtttaggttggagattatgtgttggggattggtgttgggtgggttaatggggttgttgtatttttattattttttagttggtattgaaagtttggtttatttttttattgagtgaggtgttttgtatggaattgaagggtagagaaatttttaaaggttttgagttttttgtatgtatatatattggtataattttttttagttgatttggaagttttgtggttttattgggttgttggtttttttatgttttaaagatggggtggaaggttagtaggagggtagattagtgtggatggggagtttgtgagtgttttggtaagtgtattgggatgaaattggagggagggattttttagtggtgtttgattgatatatagatgatgattttagttttttttgtgttttttgaagtgttaataagaggaataattgaataaattggttgttgttattaagggagtattaagttatttatttgtattgattgaatatttattatgtgtttggtattatatggaatgttgagggtgtaatgatgttatttatttatagttaatatggattataaaataatagatatagatgttaagtatattggttggggtggttgggaaggttttagagagaaaaggatatttgagttgggtttagaaggatgaaaagtatagaagtttttgggggtatttattttatagaattggattgaattttagttgtggtgttggatattggaatataggggtgatttagaaataatttttgttttttttaatttattgtttaattattaagggaatgaataggatgaattttagaaaaggtagttttttgggttgggttttaagaatttaggaatttttagttgggtatagttgggagggtttatttgggggtgatgtgatagtttatataattttgggtattttttttttatttttggattttgagattgttttttttgatgagtttttgttttttgtttattattttatttttttttgggattagatgtggatagagaagtggatttttttttgtttttttatagatttttttggttgtttaattttggggtttttttgggaaatgattgatatagtaatttatgaatttatttagtatttatttgttatggttatattttatttgtataggttatttttatagttgttggggatgttatggtaattaaattagagtttttttttttggaatttaatattgaaagtttttgataattgtagtagagttttagtttatgttagttattgagattatgatttttatggttttaaatattttttttttttggttttttttttttttaagggtttagaatattagttaatagttatataatattgttaggtatttttttaagtggtttagagattatattttatttaaattttttaatatagttttatgaggtaggtattaggattttttttattttata

SEQ ID NO: 1073 - DNA, 6238 bp, Artificial Sequence
  chemically treated genomic DNA (Homo sapiens)
attttagtaagattttgttttataaaaaaaaaaaaaaaaaaaaaaaaaagtagtagaggtagtagttatttattagataagatttattgtttggattgtttttaagttataattttggattttaaaattttaatatttattattgtttgttatttttttttttagggaggtaatgaaggtggggagagaattaagatttatgggttgggtgtagtggtttatgtttgtaattttagtagtttaggaggttgaggtgggtggattatgaggttaggagattgagattattttggttaatatggtgaaattttatttttattaaaaatataaaaaattagttgggtgtggtggtgggtatttgtaattttaattatttgggaggttgaagtaggagaatggtgtgaatttaggaggtggagtttgtggtgagttgagattgtattattgtattttagtttgggtgatagagtgagattttgttttaaaaaaaaaaaaaagatttaggaaatagtagatgaagtataggtagaatttatttaggaaggtatggaatggggtttgggatatgagttataaaggggaaattagatttttttagtgtgttaatttttttaaggaagttagaggatattggggtttgggaggtgttttttaagttaagattttttagaataaaggttttatttttattatagagagtggtttggaaagggtagaggtgatttggtaaatttggagagaggggttttgtttttgtggtttttggtttagtgttagggttttggggtttagaggttgtaagaagtggagttagtgagttttaggtatgtaagataatattttaagtgtttatttttttttgagtattttttgaatattatagttattaaagataagttttaattttttagaggttattaggttttgaggattaagtttagttttgtttttggaagtaggggggagagaggagtttgttggagaattttgggtaataagggttttggttggtagtgttggagtgtgttgatgaagtaatagttgaatattatatagtttatagttagttggagaattaaattaatatataaaggtgatggtgaaaaggatatagaaatgaggaggtgtattgagagaaggaaagatgaagtaggagattttttagagttttggggagattttaaaggttttagggatttttaaagattttattttttttattatttgttaattttgttatgttttttttgagttatattttttaagaggtatttatttttggatgggtttatttttaagagtagggattgtaggattttaagggaaggtttggaattatagtggttttattatttatttaggtatttgtagttggtattatgttaaaaaagttttgtagaaagaggttttattttttttttttttttttttttttggaaataaaagtaggttgtgttttttttgtttgtttttagagattagggaaatgggagttggaagggtattttggattattttgttaaatttttatttagtatattaatgtttgtgttttttgttttggttattgttgttttagtaaaggaggttaaaattagttattgtggttagggtggttgtgaagtggtttaaagattaatgattggggttgtgtagggtgggtatgtagtttttggggtttaggggaaggggaatggtggttggtgtttgggtttttttttttattggtaggagtgggggtgtatggaaggagggtattaggagagttataggtttttattggttatatgggaatagggtttggagaaggttttgtatagttatagttggagttttgtgttagggttagattgtttttgttatgggattggtttgtttattgagaaattttattgagaattgtaaatgggtatagaagattgtggagggggtagggataggggttttggagaggtaagaggggaattggtattttttatttggtgtgtgtaaattaagattttattttgtgttgggttttttttttttggtttaatttttttatttgtttttatttttgtttttaaggtttgtgatttgtggaggtgatgggggggataggagagttttagggattgtagaggtgatataattgtttgtttgtttttttttgttgggagttgatttagtttgtgttgagtttttttttttgtgtgtttttgtgtatagtggtggtattgtaggattttgggttttttttggttttttattgggaagttggtaaatgtgtttttttaggtagattgtggtggggtgggggtggggggggggtggaagttgaaatattgggatagaaatatttgtttgttttaagggatggaaaattggatgttaagggggttgtggtgtgtagtgggaggtgaggggagattgggggttgttgtgtattgtttgtagttgaggggtgagtggtgattttgtgtgttttagtgtggtttggttatggaggttggggtgtagggggtgttggtgggatttattttagagtagagtgagtggtttggttttggggatgagtattagggagtatatggtttttaagtggagtaagtttattaggatgatatttttttagatgatgttttgttgttgtttgtgtgtgtttggtttttttgggttgttgttgtttttagagtttttgagtttggtatggattttttttttggtgttgtagaaagggattttttttgtgttggtggttgggtttggtatggttgggtgaggtgggtgtttgtagtagtggtaggtaggtaggtgttttgtttgagtggagtttgagggtgggggtgggggtttttgttttttaggggggaattttttgtatgtttagttttttttttttagttttttttttgggtttttgtgtttttttttagggttttagtgtggtttagggatgtagattttggtggttggtgtttgttgttggtgtattttttatatggttgtttgggttgaatttggttgtgagaaagaggaggtgtgtgtggggtgggaggggtgtgtggttggggaggaggagttgtgaaaatggaatggggttggtgatgttggagggagtgttttgaaggagtgtggaagaaagttttgtttagttatagttaattaggagtgtttgtgtggtgtttatagataaaggtgttttttttttggttttttggggttgaattggggagtttgttgggtgggagttggttgtttttgtttgggggtgggtggaaggtggtttttggggtagggagtttgtagggtggtttatagtgtttttgtttttgtgtgtgtgtgatttttaaaatgttttttatggtatttttttagttttttttttaaaaaaaaattttttgaaattgttatttttttgagaagttttttatttttttttaagttttaggttatttgggttggagaattttaaatatttgtttggagttgtgattttagttaaggttagatttatgatgagaattagaagttttttaatttgttagttagtagggttttttgggttaggggagggttggaaggtagttgtttgtttttaattaggtagttgtggattatttaggtatatagtaagtgtttagttggtgtttgtgaggtgatgtatagatgatttgggttagtttgttgtttattttttgtttatttgttgtgttattttgtttatggttaattttagttaattagtgtatttttgtaatgtttttttagtttttagtgaggaatattattttgaaattaatattattgagaattgggttttataaaaaaattatttagaatgttttaaggaaaattaatttgtgaaagatttgtgtttgtttattttttttttagagttgatggtttaagagttttttagagaggattttagttgtatagaaaatggagggaggattgagttggaagtgtttgaagtaggtgtgattgtaattgtgggtaggtagtagaagtaaaagggtttgggatagtatttttgagttttagttttaattggttggaatttagtttaattttttgggtatggatttttttatttgagaagtagaattagtttttatttttttttttagtttttatattttatgaatgtgagtttgaaggggtgttattatattgattaaaattagttgatttttagattaattgttgttaggaattatttttaggattttaagagaggtaaaaaaatttaaaagattgattgtatgaaagggttatgtataagtattttattgttagtagatttgagttagttttagtagttagataaaataatgtttgatttaagttaaagtaaggtatgtggtatttgtggaatttaggttattgagttagtgttattgtgttgttttagatggagttgaaattatagaatttgtttggagattagataaatgttggttttatataatgattagttagatagtggaatatgaagttggagggtgtgatttttatttgtttgtttaatttgggttatgtaatgaattatgttttttttttatgttttttttgttttttatatttagtagatttttttattttttgtggttttttagtttagattgttttttttttttggggtagattagttgtttggttaaaagtttttttttgggttattggaaaggtttaatgttgtaaagatttttattttaaatatttagttatttatttggtatttattgggtatttgttatgtgttaggattagtgggtataggggatttaaggatgaataaagtttggttttgtttttaaaggagtttttatttagaagtaaagatggagtaaataaatgtaattttttgattatgattttggaagggtagaaagttatagtttattattggaaaaaaaaatttaattaggtattaaatttatatataaggagtttaagggaagtaaaaatagttttttattgttttttttgagaattttattaggttagttgttttattttgaatttattttttgtttgtttgtttgtttttgtttttgagatggagttttgttttgttgtttaggttggtgtgtagaggtttgattttggtttattgtaagatttgttttttgggtttatgttatttttttgttttagttttttgagtagttgggattataggtgtttgttattatgtttggttatttttttttttttttttttttttgtatttttagtagagatgggggttttattgtgttagttaggatggttttgattttttgattttgtgatttgttagttttggttttttaaagtggtgggattgtaggtgtgagttattgtgtttggtttttgaatttattttgaatgaatatttttttttttttttttttgtgggttagattaggtatgattagttattttagttggttgtttttataatggagaagatgtttttgtgtgttgagggaggaaagaagtgttatttaggtttgttagagtttgtttataaaaggattgttgaagaaaaatggtttttttaggtttagttttagagtgaaatatttataagatttaagatatatttttgttgataatgatggttttttttagttaattatgttataggggttattgttttttttttttgttttgttaaagattttagtatatttttttagtttttagttaggattttaggagtggataagtatttatttgttttaggatggggtaaatgggatagtaatttttattttgttaaatatgtaattattaaaaatgtaataagagttataatggtggtatatgtaagataatgtagaggtgtaaaggagggagttgttaatttatatagaagtagggaggagggggagtgatatttggggaaggatttttaaaaaatatttaattgtggtaaaatatatgtaatataaaatgtatgtaataaaatttattattgtaattgtttttaaatgtatagtttagtagtgttaattatatatgtatattattgtgtaattgatttgtagaattttattattttgtaaaattgaaattttatgtttattaaattttttttttaatttttatttagatgttggtaattattgtgttattttgttttaattagtttgattattttagatatattatataagtgaaataatagaggatttgtttttttgtgattggtttattttatttagaatgtttttaaagtttatttaggttgtatgtgttagaattt

SEQ ID NO: 1074 - DNA, 6238 bp, Artificial Sequence
  chemically treated genomic DNA (Homo sapiens)
gaattttaatatatataatttggatgagttttgaaaatattttaagtgaaataagttagttatagaaagataaattttttattattttatttatatgatgtatttagagtagttaaattaattgaaataaagtagtatagtggttgttagtatttggatggagattgaaaggggagtttaatgagtataaagttttagttttgtaaaatgataaagttttgtagattggttgtatagtaatgtgtatatatagttaatattattgaattgtatatttaaaaatggttatagtggtaaattttgttatatatattttatgttatatgtattttattataattaaatattttttaaaaatttttttttaggtattatttttttttttttttgtttttgtgtgaattaataatttttttttttgtatttttatattattttgtgtatattattattatggtttttattatatttttggtaattatgtgtttgataggataagggttattgttttatttgttttattttgggataggtgaatatttatttatttttggggttttgattagaagttaggaaaatatattagggtttttggtaagatagagaaaagaggtagtgatttttatggtataattggttaaagaggattgttgttattagtaagaatatattttggattttgtagatgttttattttgaggttggatttggaaggattatttttttttaataatttttttataggtaggttttgataaatttaagtaatatttttttttttttttaatatataaaaatattttttttattatgaggatagttagttgaaatgattggttatatttggtttgatttataggagggaaaagagaaagatgtttatttaagatggatttaagggttgggtatagtggtttatgtttgtaattttattattttgggaggttaaggttggtggattataaggttaggagattgagattattttggttaatgtagtgaaatttttgtttttattaaaaatataaaaaaaaaaaaaaaaaaaaaaatagttgggtgtggtggtgggtatttgtagttttagttatttgggaggttgaggtaggagaatggtgtgaatttgggaggtagattttgtagtgagttgagattaggtttttgtatattagtttgggtaatagagtgagattttgttttaaaaataaaaataaataaataaataaaagatggatttaagatagaatagttgatttaataaggtttttaggggggataataaggaattatttttgttttttttagattttttgtatgtaagtttgatatttaattaaatttttttttttgataatggattgtaattttttgtttttttaaggttatagttaagaggttatatttgtttgttttatttttgtttttagatgggagtttttttaggggtgggattagattttatttatttttggattttttgtgtttattggttttggtatatagtagatgtttaataaatgttaaataaatgattgaatgtttagaatgagggtttttatagtattgagtttttttaataatttggagagaggtttttggttgagtaattagtttattttagagagaaaggatagtttgaattagagagttatagggagtaggaaggtttgttgggtatggggagtagagggagtatgagaagaaaatgtggtttattatatagtttaggttgaatagatagatgaaaattgtattttttagttttatgttttattgtttgattggttattatatagggttgatatttatttggtttttaggtaaattttataattttagttttgtttgaagtaatatagtaatattgatttagtggtttagattttataagtgttatatattttgttttagtttaaattaggtattgttttgtttggttgttaggattggtttaggtttgttaataataagatgtttatgtatggtttttttatgtagttagttttttaaatttttttgttttttttgaaattttggaaatgatttttaataatggttaatttaaaaattagttggttttggttaatataatggtgtttttttgaatttatatttatggaatatggaagttggaaggaagagtagaaattagttttgttttttaggtaaggaaatttgtgtttagagagttgggttgggttttagttagttaaaattagaatttagagatgttgttttgagtttttttatttttgttgtttgtttgtaattgtggttatatttgttttagatatttttagtttaattttttttttattttttgtgtaattagggttttttttggagagtttttaagttattagttttaggagagaagtgggtagatataaattttttataggttaattttttttggaatattttgggtgatttttttgtaaagtttgatttttaatggtgttgattttagggtagtgttttttattgagagttaaggaggtgttgtagaagtgtgttgattagttagaattgattataaatagagtggtgtggtggatgggtaaagggtgggtagtgaattggtttaaattatttgtgtattattttataagtattaattgagtatttattgtgtgtttgggtaatttatagttgtttaattaagaatgagtagttgttttttaatttttttttggtttgaggagttttattaattggtagattgagggatttttgatttttattgtgggtttggttttaattagggttgtgattttaagtaagtatttaaaattttttaatttaggtggtttgaggtttgagaagaaataaaaggttttttaaagggatgatagttttgggaagtttttttttgggggggggattggaaaaatattataaaaggtattttgggggttatatatatataagagtagaagtgttgtgagttgttttgtaggttttttgttttgggagttattttttatttgtttttgggtggaggtggttaatttttgtttagtgggttttttagtttggttttgaaaagttgaaaggggggtgtttttgtttataagtgttgtatgggtgtttttgattggttgtagttaagtagggtttttttttgtgtttttttggagtgttttttttagtgttgttggttttgttttatttttatagttttttttttttggttgtgtgttttttttgttttgtgtgtgtttttttttttttgtggttgagtttagtttgggtagttatatgggggatatgttagtaatagatgttggttgttaagatttgtatttttaggttatgttaagattttggggaagagtgtaggagtttgggagaagggttggaaggaggggattggatgtgtggagaatttttttttaaaaggtagaagtttttgtttttatttttgagttttgtttgggtagagtgtttgtttgtttgttgttgttgtgggtgtttattttgtttagttatgttaggtttggttattgatgtggggaagatttttttttgtgatgttaaggaagaaatttgtgttgggtttgaaagttttgagggtggtggtggtttggagaggttaggtgtgtgtgggtagtggtagaatattgtttggaggaatgttgttttgatgagtttgttttatttgggggttgtgtattttttggtgtttatttttaaagttaagttatttattttgttttggggtaagttttgttggtgttttttgtgttttggtttttgtggttaggttgtgttggggtgtgtgaggttgttgtttgttttttggttgtgggtggtgtgtagtgatttttggtttttttttgttttttgttgtgtgttgtggtttttttggtatttagttttttgttttttgggatgggtaggtgtttttgttttagtattttaatttttgttttttttttgtttttattttgttgtggtttgtttgaggaagtgtatttgttggttttttgatggagagttgggggggatttggagttttgtggtgttattgttgtgtgtagaggtgtgtgaagggagaggtttggtataggttgaattggtttttagtgagggaggatgggtgggtgattgtgttatttttgtggtttttggggtttttttattttttttattatttttgtgggttatggattttggggatagagatgaggataagtaagggagttggattggggaggagagatttggtataggatagagttttggtttatgtgtattagatggaagatattggttttttttttgtttttttaaggtttttgtttttgttttttttgtaattttttatgtttatttgtagtttttggtgaagttttttggtgagtaaattgattttatggtgagagtggtttgattttagtatgaagttttgattgtggttgtgtagagttttttttaaattttgtttttatgtggttagtgggaatttgtggtttttttggtattttttttttgtgtatttttatttttgttagtagggaagggagtttgggtgttgattattatttttttttttttgggttttagggattgtgtgtttattttatatgattttagttgttgatttttgaattattttgtagttgttttggttgtaataattggttttggttttttttattgaagtggtagtagttaggataaaaggtataggtattgatatgttgagtgagaatttgatgaggtaatttaagatgtttttttagtttttgtttttttgatttttaggggtgggtaggagaaatataatttatttttatttttagaggggaagaggaaggaagaaaataagatttttttttatagggtttttttggtatggtgttagttgtaaatgtttaggtagataatggggttattatggttttaagtttttttttgaaattttgtagtttttgtttttggaagtaaatttatttagaagtgggtattttttagggggtgtggtttagggagggtatagtagagttgatggatggtgagagaggtaggatttttggggatttttaaagtttttaaagtttttttaaagttttgggaaattttttgttttattttttttttttttagtgtatttttttatttttgtgttttttttattattatttttatgtgttggtttaattttttaattgattgtagattgtatgatgtttagttgttgttttattaatatattttgatattgttaattaaagtttttattgtttagagttttttaataagttttttttttttttttgtttttagaggtagggttgggtttggtttttagagtttggtgatttttaggggattgaggtttatttttaatagttgtggtgtttagagagtgtttagggaaaagtgagtatttaaaatattattttatatgtttagggtttattggttttattttttatagtttttgagttttaagattttggtattggattaggagttataaggataaggtttttttttttaagtttgttaggttatttttgttttttttggattgttttttgtggtgaagatagaatttttgttttgaaagattttggtttagaggatattttttaggttttagtgttttttagtttttttagagaagttaatatattgaaggaatttggttttttttttgtgatttatgttttaaattttattttatatttttttggataaattttgtttgtgttttatttgttattttttaagttttttttttttttttgagatagagttttgttttgttgtttaggttggagtgtagtggtgtgattttggtttattgtaagttttgttttttgggtttatattatttttttgttttagttttttaagtagttgggattataggtgtttgttattatgtttggttaattttttgtatttttagtagagatggggttttattgtgttagttaggatggttttaattttttgattttgtgatttatttattttagttttttaaattgttggaattataggtgtgagttattgtgtttggtttgtaagttttaattttttttttatttttattgtttttttaaaaaaaaaaatagtagataatggtagatattagagttttaaggtttaaaattgtgatttagaaatagtttaaataatgggttttatttgatgaatagttattgtttttgttgtttttttttttttttttttttttttttgtgagatagggttttgttggagt

SEQ ID NO: 1075 - DNA, 4770 bp, Artificial Sequence
  chemically treated genomic DNA (Homo sapiens)
atagagtgtgaggtggatagttttgtttatttaagagttatatttagattgagtgaattatgattttgggttttatgtttttttgttttttgtaagggggtttgttgtttatgtgtttttggtttttaaaagtgtgattatgttgattgttttttgagttttgtggggatttagaaatttttagtgaagtgtggaaaagtagtattttgtttttgtttttttttttagtttttaaataggttatagtggagattttttttgttgtaggaaataggaatttgtggttaggttgtgatgtatgggatgttttttttttttgtagttttgtttttgttttttatatgaaaatgaatgagttttatattattgtgtgtgtgagattattatggtaatggtgatatttataggtattgttgtttttatggagagggtatggaaaatttaagattgttatggaagtttagttttatattttattttttagggtggtttttgtttgaaaattgtgggagttaagatagtggtttttagtttttatagaattattggagaattttagagtgttagtttttgaagttttttttttttttttaatttggttttatatttatttattttataaggttttggtttttgtggtttttggttttggagggtgggttattttgggattttgggttttgagtttatgtatgtttataatggggtggaggtggtaggttttattaagggttttttggttggatttgtttgtagtgtagaggttggttgaggtgtatgggagtttgttggtttttttttgtttgtgtttgttggtgaaattttggttggggttttttgtgatggtttttttgatatttttggatagtattttttttgtggaagtttgaggatgaggatggtgaaggagatttgtttggattttgagttaaagtgaggttttgtgagtttgttttgagtggaatttgtatttgggtattgttattagagaatggttggtttaggttattggtattttggagtttagggtttagatttggttttagaatgagaggttatgttagttgaggtagtattggtgggaattttggttttggtttgggagatgtggtttgtaagaaggtaggtgaaagtggattgttgttattggattttagattgttttgtttttttgagtttttgagaaggattgttttttaggtattgttgttagggaagagttggttagagagatgggttttttggagtttaggatttagatttggttttagaattgaagggttaggtatttgggatagggtggtagggtgtttgtgtatgtaggtggtttgtgtaatgtggtttttagtgggtgttattttgtttttttgtgggttgtttgtgtttatattggggtgtggggaatggggttttttgtattttatgtgttttgtgtgtttggggtttttttatagggggtttttgggagttagggagtgagggttgtttttgtgttttagtttagttaggttgtgttggtagaggggattttttaatttgttttggtatttgggattttgtgttttttgttttagtttttttggaagtgggattgttttatttttagattttttggaggtttttgtattttagtaaatgataggaggattaggatttgtagtgtgatggtttgttgggtgtgtgtttagtgggatagtttgggtttttttaagttgagttataggggtaaggtgtgtttgtgttatttatgttttattggagtttgtggtggggttggagttttaggttgttagggtggtgtgggaatttgaagatggggtatttttatttttgaagtttgtgattttggaggtttttgtgttaagtatagatgttagttatttaggtgttttttaattgttttaggagttggggtgtttgtttgtatttatttttagtttgttagatgagtttttgttaattttagatttttagtaaaaggtataattttttttagatttggtgttattgggggagttgaaggaggtggaagagtttgttttgttggaattattttttagttaggaagaatatggggttttgttggaggagttttaggatgttgggttggggtggggtgggggtagggtggtggtttttttttggtggtgaatttttggtttggtatggagaggtgtgtttttttttttagttgatttgtttaggatttttgggttttaggtttggtgagagattttatatagaggagggttgttatttttttttgagtattttggggattttagggtttgtttatgtattgggaggtggattgtttattgtttatgtgggggtttgtaggtaatagtttaggttttttaattagtttaggtggagtttgtattttttttttttttgtgttttttagttgggttggtggagattttagtttgtgaaatattgggttggggtagaagttaggttagtttttttttttgtggtttgatttttttgtttttttttttattattatttgttaatttgtgttttattagtttttttgttagtattatggagtgttttgtaattaaatgtagatttgagattttgtgtaaattggggtgttgttttttttaggtaagagggaaggtaggtagagatgaggataggaatggagatagagtgggatggaaggatggagttaggaaaggatggatggatggagggattttggaagggagaggaagagggagagagggagaaagggaggaaaaaattagggtagggagggaagaatagagggtaggatggattgagggataaaaggagtaagaaatagagaattgaaggtagatagaaaaatggttttttgtttttagaattaataggatttagtaatttgggaaaatgttgggtgtttagtgtgggttaagtgttgggtttatagttttgttggttggtggggagtttagtggttttttggattgttagtttgggttattttattttagagtgatttagatgaattttgtttttgaaggaatgagtgaattttttagagagtaatgagtggagatttgggtggttgtttgttttttatttatatggtttatagatgatatatttttatgtttagttttgtaatagagtgtgaggtggatagttttatttatatagaagttatgtttaggttaagtgaagtgtgattttggattttatgtttttttgttttttgtaaaggtgtttgttatttaagtttttgttgtttttggaaagtgtgattatgttgattgttttttgagttttgtggggatttagaaatttttaggaatgtgtggaagattagtattgtgttggtgtttttttttttagtttttaaataggttatattgaagattttttattttgtagaaaataggaatttatttttaggttgtgatgtatgggatgtttttttttttttgtgtttttgtttttattgtttatatgaaaatgaatgagatttatatatttgtgtgtgtgagattattatggtaattatgatatttatgtgttggtaatagagttggtagtttgattttaggataaaggtattgatggatatttagatatattttattataattattagtaaatttatttttaaatagatatatatgggtgtatgtgtgggaatataagtatatatgtagatatataaagatatagatagtttgaagaagagtaagggatagagggatggagagatagaaatggaaggagagagagaaatagtgatagagagagagatagagagggatggggaaattgtgagagagagagagagagagagagagagagagagatagagagagagagagagatagagagggatggggaaattgtgagagagagggagagagagagagagagagagtaaggtggagagggaagtagagaaagggagagggtgagggagttagagagggggagtaatagagttttggagagggaggttttgttttggtagataggggattttttggtgagggtagggtggagggtgtttgggttgggttagaataggagggtagggttgtttatgtgggaaaattaatggagttttgagatgtgtttttatttggattggttggttgttttgggtgtgtgttttttagtgttatttttttgttggtttttttttgtttttttggtgttgtgggttttgaaagttgttgagtgtgtttgtttttgtggtgggagtagtggtgttgagtgtgtttatgggttgttgtttgggttttttttgtgtttagggtagtatggatgtggataatggtagtggtttttggttggtttaagagttgggtttagatatgtgtgtttgattttaggtgttataattaatttggggttgtgaggttgggattaggtattttggagttgtttgtttgtggttgggttgttttttttttttaagtttaagtattgttagttgtggtgttgtgttttttgttgattttttagagtgttttgttgttgttggtggttagttttgtgtaggattagtgtggtgttgttttgttgttgttggggggtgtttgaggtttttattttttgtttaggtttttggtttttggggtggttttttttttgtttatgttttagggtttttttggtttttgagttttgagtttttattatattggttggtttaggataggtatgtttattttgttattttttaattttttgttgtttttatttatattttattgtgttatgttttgaaatgttgttgtagttattatt

SEQ ID NO: 1076 - DNA, 4770 bp, Artificial Sequence
  chemically treated genomic DNA (Homo sapiens)
agtaatagttataataatattttaagatatagtataataaaatataaatagaaataataaaaagttaaaaagtgatgggatgagtatatttgttttgagttggttgatgtggtggaagtttggagtttgggagttggggaagttttggagtgtgggtggaagggaggttgttttgagagttggaagtttgggtaaggaatggaggttttgggtgttttttagtaatagtagggtggtgttatattggttttgtgtgaggttggttgttggtgatggtgggatgttttgggaggttggtggaaagtgtagtgttgtgattggtggtgtttaggtttagagggggagagtagtttggttatgggtaagtggttttggggtgtttgattttagttttgtggttttgggttggttatgatgtttggaattaggtgtgtgtatttggatttggtttttgggttagttaggggttattgttattgtttatgtttatattattttgaatatgagagaaatttaagtggtggtttgtgggtatgtttggtgttattgtttttattatagggataggtgtatttgataatttttagggtttatagtattaagaggatagggaggagttaataaaggaatgatgttaggaaatgtatgtttaaagtaattaattaatttaagtaaaaatatgttttagggttttgttggtttttttgtgtgggtggttttgtttttttgttttagtttggtttaggtattttttattttatttttgttaaagggttttttgtttattagagtagagtttttttttttaaggttttgttgttttttttttttagtttttttattttttttttttttttatttttttttttattttgtttttttttttttttttttttttttttttttgtagtttttttgtttttttttgtttttttttttttttttgttttttttttttttttttttttttttttttttttgtagtttttttgtttttttttgtttttttttttattgttgtttttttttttttttttgtttttatttttttatttttttgttttttgtttttttttaagttgtttgtgtttttgtgtgtttgtgtgtatgtttgtgtttttgtgtgtgtgtttgtatgtgtttgtttgggagtgggtttgttagtgattgtggtggggtgtgtttggatgtttgttagtatttttgttttgggattaggttgttaattttattgttagtgtgtgggtgttatagttgttgtgatagttttatatatgtaggtgtgtggattttgtttatttttatgtagataatgagagtgaaagtatagagaaaaagaaatgttttgtgtattatggtttgaggatggatttttgttttttgtaaaatggggagtttttgatatagtttgtttgaaaattggaaaggagagtattgatatgatgttggttttttatgtatttttggaagtttttgggtttttatagagtttgggaaatagttaatatggttatgttttttgggggtggtagagatttgagtaataggtatttttgtagagagtaaagaaatgtggaatttagaattatgttttatttggtttgagtgtgatttttgtgtggatgggattatttgttttgtgttttgttgtagggttaaatgtggggatatgttatttgtgaattatgtggatgaaaaatagataattatttgagtttttgtttattgttttttggggaatttgtttatttttttggaaatggaatttgtttgaattgttttgggatgaagtaatttaggttggtgatttggagggttgttgagttttttattggttaatggggttgtgggtttagtatttagtttgtattgggtatttaatatttttttggattgttgggttttgttggttttggaggtagaagattgtttttttgtttgtttttggttttttgttttttgttttttttgttttttggtttattttgttttttgtttttttttttttgttttggttttttttttttttttttttttttttttttttttttttttttttagggtttttttgtttatttatttttttttagttttatttttttgttttattttgtttttgtttttgtttttatttttgtttgtttttttttttgtttggaaagggtagtattttggtttgtgtggggttttgggtttatatttagttgtaaggtgttttatggtgttggtgaggaggttggtgggatatgggttggtaagtgatagtgagagaagaggtagaggaattgagttgtagaaaggagaattggtttggtttttgttttgatttagtgttttgtggattgaggtttttgttaatttgattgaagaatgtggggggaaaagggatgtgagttttgtttgggttggttagaaaatttaagttgttgtttgtaaatttttgtatgagtagtagatagtttattttttggtatgtggatgggttttgggatttttgggatgtttaggaaagaatgatagtttttttttgtgtggagttttttgttggatttggaatttagggattttagataggttaattggaagggaagatatgtttttttatattgagttagaggtttattgttaaagagaggttgttgttttgtttttgttttgttttaatttggtgttttaaagtttttttagtagagttttgtgttttttttggttgaggagtggttttagtggagtaggtttttttattttttttagtttttttagtgatattggatttaggaaaggttgtgttttttgttgaaagtttggggttgatgggagtttatttaataggttggaggtgagtgtagatgagtgttttggtttttggagtggttgggaggtgtttggatggttggtatttgtgtttgatgtagaggtttttggggttgtgagttttggaggtggaggtgttttgtttttgggtttttatgttgttttggtgatttggggttttagttttattgtggattttggtgggatgtgggtggtgtaagtatattttgtttttgtgatttagtttgagggggtttaagttgttttattgagtatgtgtttagtaggttgttgtgttgtgggttttggtttttttgttatttattggggtgtggaggtttttgaggagtttgagggtgggatagttttatttttggaggagttagggtagggaatataaagttttgagtgttggggtaggttgggagattttttttgttggtgtggtttggttgggttggagtatggggatggtttttgttttttggtttttgaaagttttttgtgggagagttttaggtgtgtagggtatgtgggatgtgggaagttttgttttttatgttttggtgtgggtgtaggtgatttatgagggagtagggtgatatttgttgggggttgtgttgtataggttgtttgtgtgtgtgggtgttttgttattttgttttgggtgtttggttttttgattttgaaattagatttgaattttggattttgggaggtttgtttttttggttagtttttttttggtggtgatgtttggaaagtgattttttttaaaggtttggaggagtagggtggtttgggatttggtgatggtggtttgtttttgtttgtttttttgtaggttgtgttttttgggttagggttgagatttttgttggtgttgttttagttggtgtgattttttattttgaaattaaatttggattttgggttttggaatgttgatggtttgggttagttgttttttggtggtgatgtttgggtatgggttttgtttaaagtaggtttgtaggattttgttttggtttggggtttaaatgagttttttttgttgtttttgtttttgggtttttgtggggagggtgttgtttgaaggtgttgggagggttattgtggggagttttggttggaattttattgatggatatgggtggagagaggttggtgggtttttgtgtattttagttggtttttgtgttgtaggtaggtttagttaggaggtttttagtaagatttattatttttattttgttatgaatatgtatgaatttggggtttaaggttttggggtagtttgttttttaaagttgaaaattatagggattagggttttgtggggtgggtgggtgtagggttagattggaggggaaaaaggggttttgggggttggtattttaaggttttttagtaattttatggaaattggaagttgttgttttgatttttatagtttttaggtagaaattattttgaagggtggagtgtggaattgaatttttatgatagttttgagttttttatgttttttttgtgaaggtggtaatgtttgtgggtgttgttgttgttgtgatagttttatatatgtagtggtgtggaatttgtttatttttatgtagaaaatgagagtgaaattatagagaaaagaaatgttttgtgtattatggtttgattatggatttttgttttttgtaataagggaagtttttattgtggtttgtttggaaattggaaaggagagtgaagataggatgttgtttttttatgttttgttggaggtttttgggtttttatagagtttgggaaatagttaatatggttatgtttttgggggttggagatatgtgaataataggtttttttgtagagggtaaaggaatgtggaatttagaattatggtttatttggtttgagtgtgatttttgaatggatgggattatttattttgtgttttgt

SEQ ID NO: 1077 - DNA, 19 bp, Artificial Sequence
  chemically treated genomic DNA (Homo sapiens)
ttttggttgcgtcgggtac

SEQ ID NO: 1078 - DNA, 22 bp, Artificial Sequence
  chemically treated genomic DNA (Homo sapiens)
accgaaacacgaacctaaacga

SEQ ID NO: 1079 - DNA, 18 bp, Artificial Sequence
  chemically treated genomic DNA (Homo sapiens)
aaacgccgctcgcacgcc

SEQ ID NO: 1080 - DNA, 25 bp, Artificial Sequence
  chemically treated genomic DNA (Homo sapiens)
aaagcgagaaaattttattgcgtac

SEQ ID NO: 1081 - DNA, 25 bp, Artificial Sequence
  chemically treated genomic DNA (Homo sapiens)
atactcgatacctaacgactccgaa

SEQ ID NO: 1082 - DNA, 27 bp, Artificial Sequence
  chemically treated genomic DNA (Homo sapiens)
cgaacgactccatcgataactccatcg

SEQ ID NO: 1083 - DNA, 18 bp, Artificial Sequence
  chemically treated genomic DNA (Homo sapiens)
ggagcgtttcgaaggagc

SEQ ID NO: 1084 - DNA, 18 bp, Artificial Sequence
  chemically treated genomic DNA (Homo sapiens)
cgaccccgaaaaaccgaa

SEQ ID NO: 1085 - DNA, 23 bp, Artificial Sequence
  chemically treated genomic DNA (Homo sapiens)
taaacgccgcacgaacgctccta

SEQ ID NO: 1086 - DNA, 22 bp, Artificial Sequence
  chemically treated genomic DNA (Homo sapiens)
gggatttatcgagtacgttcgc

SEQ ID NO: 1087 - DNA, 20 bp, Artificial Sequence
  chemically treated genomic DNA (Homo sapiens)
cgcgtactacgaaaacgacg

SEQ ID NO: 1088 - DNA, 24 bp, Artificial Sequence
  chemically treated genomic DNA (Homo sapiens)
acttcgtaacccgacaccgttccg

SEQ ID NO: 1089 - DNA, 19 bp, Artificial Sequence
  chemically treated genomic DNA (Homo sapiens)
tggtgttttcggatacggc

SEQ ID NO: 1090 - DNA, 19 bp, Artificial Sequence
  chemically treated genomic DNA (Homo sapiens)
aaaaacgtcccgcctaacg

SEQ ID NO: 1091 - DNA, 23 bp, Artificial Sequence
  chemically treated genomic DNA (Homo sapiens)
cgcgaaatccaaacgaccgtacg

SEQ ID NO: 1092 - DNA, 25 bp, Artificial Sequence
  chemically treated genomic DNA (Homo sapiens)
gaaaaaataaaatcgataaccgtcg

SEQ ID NO: 1093 - DNA, 28 bp, Artificial Sequence
  chemically treated genomic DNA (Homo sapiens)
agtagtttttttcgacgtagtttcgttc

SEQ ID NO: 1094 - DNA, 28 bp, Artificial Sequence
  chemically treated genomic DNA (Homo sapiens)
taccgacgacgaaaaaaaaccgaaaatc

SEQ ID NO: 1095 - DNA, 22 bp, Artificial Sequence
  chemically treated genomic DNA (Homo sapiens)
cgttaggacgttggtttcgttc

SEQ ID NO: 1096 - DNA, 20 bp, Artificial Sequence
  chemically treated genomic DNA (Homo sapiens)
gaaacgacccgaacgaaaca

SEQ ID NO: 1097 - DNA, 32 bp, Artificial Sequence
  chemically treated genomic DNA (Homo sapiens)
ctcgaaaacctccaaattcaaatcgctaacta

SEQ ID NO: 1098 - DNA, 21 bp, Artificial Sequence
  chemically treated genomic DNA (Homo sapiens)
gttttcggttgtaggaatcgc

SEQ ID NO: 1099 - DNA, 23 bp, Artificial Sequence
  chemically treated genomic DNA (Homo sapiens)
ccatcctcgctataccctaacgt

SEQ ID NO: 1100 - DNA, 27 bp, Artificial Sequence
  chemically treated genomic DNA (Homo sapiens)
ctaaccgcgaacgaaaccaacgtccta

SEQ ID NO: 1101 - DNA, 26 bp, Artificial Sequence
  chemically treated genomic DNA (Homo sapiens)
ttagttaggtcgtcgattttatttcg

SEQ ID NO: 1102 - DNA, 21 bp, Artificial Sequence
  chemically treated genomic DNA (Homo sapiens)
gaatttaaactcgcctacccg

SEQ ID NO: 1103 - DNA, 26 bp, Artificial Sequence
  chemically treated genomic DNA (Homo sapiens)
cgctacctctaaccgacaaacgtccg

SEQ ID NO: 1104 - DNA, 18 bp, Artificial Sequence
  chemically treated genomic DNA (Homo sapiens)
agggcgttcgcgtacgta

SEQ ID NO: 1105 - DNA, 21 bp, Artificial Sequence
  chemically treated genomic DNA (Homo sapiens)
cccgatataaacgcaaacgac

SEQ ID NO: 1106 - DNA, 26 bp, Artificial Sequence
  chemically treated genomic DNA (Homo sapiens)
cgctaaaaaccgcgttacacaaaccg

SEQ ID NO: 1107 - DNA, 20 bp, Artificial Sequence
  chemically treated genomic DNA (Homo sapiens)
tcggaggcgttttttaatcg

SEQ ID NO: 1108 - DNA, 25 bp, Artificial Sequence
  chemically treated genomic DNA (Homo sapiens)
cgaaacgcgataaaacttataatcg

SEQ ID NO: 1109 - DNA, 27 bp, Artificial Sequence
  chemically treated genomic DNA (Homo sapiens)
aacgaaacgaaacgaaacgacgtacgc

SEQ ID NO: 1110 - DNA, 20 bp, Artificial Sequence
  chemically treated genomic DNA (Homo sapiens)
tttttattttcggcgttcgc

SEQ ID NO: 1111 - DNA, 25 bp, Artificial Sequence
  chemically treated genomic DNA (Homo sapiens)
ctcatataaaattccgaaaacgacg

SEQ ID NO: 1112 - DNA, 32 bp, Artificial Sequence
  chemically treated genomic DNA (Homo sapiens)
acgaatctccgaaaccgataaacgaaaccata

SEQ ID NO: 1113 - DNA, 24 bp, Artificial Sequence
  schulz25 primer
cggtttttttcgtcgttttttatt

SEQ ID NO: 1114 - DNA, 22 bp, Artificial Sequence
  schulz25 primer
aaacgaatacgaaaacccaacg

SEQ ID NO: 1115 - DNA, 29 bp, Artificial Sequence
  schulz25 probe
ctcgaacgccctacgtactcaaacgaaaa

SEQ ID NO: 1116 - DNA, 2117 bp, Homo Sapiens
atggtggctcacacctgtagtcctagcactttgggaggcagaggtgggtggatcatgtgaggtcaggagttcgagaccagcctggccaacatggtgaaaccccttctctactaaaaatacaacaaacaaacaaacaaacaaaattgtagagttggggtctcactatattgttcaggctggtctccaactcctagcctccagccatcttcctggcttggcctcccaaagtgctgagattacaggcatgagccaccgaaactggcctttttgcacttgttgagtgcagagttgaagttcaaggacagattctggctccccatggcgtgggttcaaatcccactgtcactcctagctcacagaaggggaattgatgtccagggccacccagcaggtcgtgctgcagtcacagcagctcacaacttctcaccccaacccctgctgcatctcccagggaaccaaggggcaggggacagcgccccgacactgccaccactctcccattcctgcacattctgctcacattgtctgccgcggccttgggcccttcctaactcacatcctggggtcctgctgcccgcttctgtcattggaatcacagtcaaggaaggtgtgacctgattctccccactctgctgcttttcctctccaggctcacaattccctccgctagggcaggagatggtcctgcacactctgcaggggccttcactccaggcctccttaggaattccaaagtgctttccaaatccacccccctccccccactcggcagccaccccactcccgccacttggatatgacccatttttcagaatctagaaatctcatcagactcctcacctgctccaaactctcctacagttccccagcaccctcagaacaaaatccacaccccttccggaggcccagaagataccccgtgattgtctgtctctgctcaacctgtatccaggctggaattcactggtgtgatcactgctcactgcagccttgacctcccgggctctggcgatcctcccacctcagcctcccaaagtgctgggattataagtgtgagccacagtgcccagctgaaatcagtatttatctgctggtgaggtcagggccatcaccaccctggggtgggtccacctggatcatgctgtgtccccagcacctgccggagggccctgcacacagtatgcactcaatgaaccggcctcagcccaggcctctggccgcagcctggaccccacggtgggaagaagagaagctatgccttcccagaacttccctggagagaaggggtccatttacatgtatttgcacaatttgcatatgtttacattggtcggcagggctttgcaagtaggggatcccgctcggatctcccattgattgattgattgattgattgagacagtctcgctctgtcgccaggctggagtgcagtggcacgatctcggctcactgcaacctccgcctcccgggttcaagcgattctcctgcctcagtctcccgagtagctgggactacaggcgcgtgccatcacgcccggctaatttttgtatttttagtagagacggggtttcaccacgttggcctggatggtctcgatttcctgacctcgtgatccgcccgcgtcggccccccaaagtgctaggattacaggcgtgagccaccgcgcccagccttgatttttatttatttatttgtttatttatttattttttgagacggaatctctctctgtcgcccaggctggagtgaagtggcgcgatctcggctcactgcaacctccacctcccgggctcaagcgattctcccgcctcagcctcccaagtagctgggattacaggcggccgccaccacgcccggctaattcttgtatttttagtagagacggggtttcaccatgttggccagactggtcttgaacggatctcaagagacccgtccgcctcggccccccaaagtgctgggattacaggagtgagacaccgcacccggccggatctccccttttccaacggggtttccaggaggatgcctgaccagggtggaaggagaaagaactaggtgcctaacccactctcctggcgagggcaggaggtacgctccagccggcaacaggtgcc

SEQ ID NO: 1117 - DNA, 2117 bp, Artificial Sequence
  chemically treated genomic DNA (Homo sapiens)
atggtggtttatatttgtagttttagtattttgggaggtagaggtgggtggattatgtgaggttaggagttcgagattagtttggttaatatggtgaaattttttttttattaaaaatataataaataaataaataaataaaattgtagagttggggttttattatattgtttaggttggtttttaatttttagtttttagttatttttttggtttggttttttaaagtgttgagattataggtatgagttatcgaaattggtttttttgtatttgttgagtgtagagttgaagtttaaggatagattttggttttttatggcgtgggtttaaattttattgttatttttagtttatagaaggggaattgatgtttagggttatttagtaggtcgtgttgtagttatagtagtttataattttttattttaatttttgttgtattttttagggaattaaggggtaggggatagcgtttcgatattgttattatttttttatttttgtatattttgtttatattgtttgtcgcggttttgggttttttttaatttatattttggggttttgttgttcgtttttgttattggaattatagttaaggaaggtgtgatttgattttttttattttgttgttttttttttttaggtttataatttttttcgttagggtaggagatggttttgtatattttgtaggggtttttattttaggtttttttaggaattttaaagtgttttttaaatttatttttttttttttattcggtagttattttattttcgttatttggatatgatttattttttagaatttagaaattttattagattttttatttgttttaaatttttttatagttttttagtatttttagaataaaatttatatttttttcggaggtttagaagatatttcgtgattgtttgtttttgtttaatttgtatttaggttggaatttattggtgtgattattgtttattgtagttttgatttttcgggttttggcgatttttttattttagttttttaaagtgttgggattataagtgtgagttatagtgtttagttgaaattagtatttatttgttggtgaggttagggttattattattttggggtgggtttatttggattatgttgtgtttttagtatttgtcggagggttttgtatatagtatgtatttaatgaatcggttttagtttaggtttttggtcgtagtttggattttacggtgggaagaagagaagttatgtttttttagaatttttttggagagaaggggtttatttatatgtatttgtataatttgtatatgtttatattggtcggtagggttttgtaagtaggggatttcgttcggattttttattgattgattgattgattgattgagatagtttcgttttgtcgttaggttggagtgtagtggtacgatttcggtttattgtaattttcgtttttcgggtttaagcgatttttttgttttagtttttcgagtagttgggattataggcgcgtgttattacgttcggttaatttttgtatttttagtagagacggggttttattacgttggtttggatggtttcgattttttgatttcgtgattcgttcgcgtcggttttttaaagtgttaggattataggcgtgagttatcgcgtttagttttgatttttatttatttatttgtttatttatttattttttgagacggaatttttttttgtcgtttaggttggagtgaagtggcgcgatttcggtttattgtaatttttatttttcgggtttaagcgattttttcgttttagttttttaagtagttgggattataggcggtcgttattacgttcggttaatttttgtatttttagtagagacggggttttattatgttggttagattggttttgaacggattttaagagattcgttcgtttcggttttttaaagtgttgggattataggagtgagatatcgtattcggtcggatttttttttttttaacggggtttttaggaggatgtttgattagggtggaaggagaaagaattaggtgtttaatttatttttttggcgagggtaggaggtacgttttagtcggtaataggtgtt

SEQ ID NO: 1118 - DNA, 2117 bp, Artificial Sequence
  chemically treated genomic DNA (Homo sapiens)
ggtatttgttgtcggttggagcgtattttttgttttcgttaggagagtgggttaggtatttagttttttttttttttattttggttaggtatttttttggaaatttcgttggaaaaggggagattcggtcgggtgcggtgttttatttttgtaattttagtattttggggggtcgaggcggacgggttttttgagattcgtttaagattagtttggttaatatggtgaaatttcgtttttattaaaaatataagaattagtcgggcgtggtggcggtcgtttgtaattttagttatttgggaggttgaggcgggagaatcgtttgagttcgggaggtggaggttgtagtgagtcgagatcgcgttattttattttagtttgggcgatagagagagatttcgttttaaaaaataaataaataaataaataaataaataaaaattaaggttgggcgcggtggtttacgtttgtaattttagtattttggggggtcgacgcgggcggattacgaggttaggaaatcgagattatttaggttaacgtggtgaaatttcgtttttattaaaaatataaaaattagtcgggcgtgatggtacgcgtttgtagttttagttattcgggagattgaggtaggagaatcgtttgaattcgggaggcggaggttgtagtgagtcgagatcgtgttattgtattttagtttggcgatagagcgagattgttttaattaattaattaattaattaatgggagattcgagcgggattttttatttgtaaagttttgtcgattaatgtaaatatatgtaaattgtgtaaatatatgtaaatggattttttttttttagggaagttttgggaaggtatagttttttttttttttatcgtggggtttaggttgcggttagaggtttgggttgaggtcggtttattgagtgtatattgtgtgtagggtttttcggtaggtgttggggatatagtatgatttaggtggatttattttagggtggtgatggttttgattttattagtagataaatattgattttagttgggtattgtggtttatatttataattttagtattttgggaggttgaggtgggaggatcgttagagttcgggaggttaaggttgtagtgagtagtgattatattagtgaattttagtttggatataggttgagtagagatagataattacggggtattttttgggttttcggaaggggtgtggattttgttttgagggtgttggggaattgtaggagagtttggagtaggtgaggagtttgatgagatttttagattttgaaaaatgggttatatttaagtggcgggagtggggtggttgtcgagtggggggaggggggtggatttggaaagtattttggaatttttaaggaggtttggagtgaaggtttttgtagagtgtgtaggattattttttgttttagcggagggaattgtgagtttggagaggaaaagtagtagagtggggagaattaggttatattttttttgattgtgattttaatgatagaagcgggtagtaggattttaggatgtgagttaggaagggtttaaggtcgcggtagataatgtgagtagaatgtgtaggaatgggagagtggtggtagtgtcggggcgttgttttttgttttttggttttttgggagatgtagtaggggttggggtgagaagttgtgagttgttgtgattgtagtacgatttgttgggtggttttggatattaattttttttttgtgagttaggagtgatagtgggatttgaatttacgttatggggagttagaatttgtttttgaattttaattttgtatttaataagtgtaaaaaggttagtttcggtggtttatgtttgtaattttagtattttgggaggttaagttaggaagatggttggaggttaggagttggagattagtttgaataatatagtgagattttaattttataattttgtttgtttgtttgtttgttgtatttttagtagagaaggggttttattatgttggttaggttggtttcgaatttttgattttatatgatttatttatttttgttttttaaagtgttaggattataggtgtgagttattat

SEQ ID NO: 1119 - DNA, 2117 bp, Artificial Sequence
  chemically treated genomic DNA (Homo sapiens)
atggtggtttatatttgtagttttagtattttgggaggtagaggtgggtggattatgtgaggttaggagtttgagattagtttggttaatatggtgaaattttttttttattaaaaatataataaataaataaataaataaaattgtagagttggggttttattatattgtttaggttggtttttaatttttagtttttagttatttttttggtttggttttttaaagtgttgagattataggtatgagttattgaaattggtttttttgtatttgttgagtgtagagttgaagtttaaggatagattttggttttttatggtgtgggtttaaattttattgttatttttagtttatagaaggggaattgatgtttagggttatttagtaggttgtgttgtagttatagtagtttataattttttattttaatttttgttgtattttttagggaattaaggggtaggggatagtgttttgatattgttattatttttttatttttgtatattttgtttatattgtttgttgtggttttgggttttttttaatttatattttggggttttgttgtttgtttttgttattggaattatagttaaggaaggtgtgatttgattttttttattttgttgttttttttttttaggtttataattttttttgttagggtaggagatggttttgtatattttgtaggggtttttattttaggtttttttaggaattttaaagtgttttttaaatttatttttttttttttatttggtagttattttatttttgttatttggatatgatttattttttagaatttagaaattttattagattttttatttgttttaaatttttttatagttttttagtatttttagaataaaatttatattttttttggaggtttagaagatattttgtgattgtttgtttttgtttaatttgtatttaggttggaatttattggtgtgattattgtttattgtagttttgattttttgggttttggtgatttttttattttagttttttaaagtgttgggattataagtgtgagttatagtgtttagttgaaattagtatttatttgttggtgaggttagggttattattattttggggtgggtttatttggattatgttgtgtttttagtatttgttggagggttttgtatatagtatgtatttaatgaattggttttagtttaggtttttggttgtagtttggattttatggtgggaagaagagaagttatgtttttttagaatttttttggagagaaggggtttatttatatgtatttgtataatttgtatatgtttatattggttggtagggttttgtaagtaggggattttgtttggattttttattgattgattgattgattgattgagatagttttgttttgttgttaggttggagtgtagtggtatgattttggtttattgtaatttttgttttttgggtttaagtgatttttttgttttagttttttgagtagttgggattataggtgtgtgttattatgtttggttaatttttgtatttttagtagagatggggttttattatgttggtttggatggttttgattttttgattttgtgatttgtttgtgttggttttttaaagtgttaggattataggtgtgagttattgtgtttagttttgatttttatttatttatttgtttatttatttattttttgagatggaatttttttttgttgtttaggttggagtgaagtggtgtgattttggtttattgtaatttttattttttgggtttaagtgatttttttgttttagttttttaagtagttgggattataggtggttgttattatgtttggttaatttttgtatttttagtagagatggggttttattatgttggttagattggttttgaatggattttaagagatttgtttgttttggttttttaaagtgttgggattataggagtgagatattgtatttggttggatttttttttttttaatggggtttttaggaggatgtttgattagggtggaaggagaaagaattaggtgtttaatttatttttttggtgagggtaggaggtatgttttagttggtaataggtgtt

SEQ ID NO: 1120 - DNA, 2117 bp, Artificial Sequence
  chemically treated genomic DNA (Homo sapiens)
ggtatttgttgttggttggagtgtattttttgtttttgttaggagagtgggttaggtatttagttttttttttttttattttggttaggtatttttttggaaattttgttggaaaaggggagatttggttgggtgtggtgttttatttttgtaattttagtattttggggggttgaggtggatgggttttttgagatttgtttaagattagtttggttaatatggtgaaattttgtttttattaaaaatataagaattagttgggtgtggtggtggttgtttgtaattttagttatttgggaggttgaggtgggagaattgtttgagtttgggaggtggaggttgtagtgagttgagattgtgttattttattttagtttgggtgatagagagagattttgttttaaaaaataaataaataaataaataaataaataaaaattaaggttgggtgtggtggtttatgtttgtaattttagtattttggggggttgatgtgggtggattatgaggttaggaaattgagattatttaggttaatgtggtgaaattttgtttttattaaaaatataaaaattagttgggtgtgatggtatgtgtttgtagttttagttatttgggagattgaggtaggagaattgtttgaatttgggaggtggaggttgtagtgagttgagattgtgttattgtattttagtttggtgatagagtgagattgttttaattaattaattaattaattaatgggagatttgagtgggattttttatttgtaaagttttgttgattaatgtaaatatatgtaaattgtgtaaatatatgtaaatggattttttttttttagggaagttttgggaaggtatagttttttttttttttattgtggggtttaggttgtggttagaggtttgggttgaggttggtttattgagtgtatattgtgtgtagggttttttggtaggtgttggggatatagtatgatttaggtggatttattttagggtggtgatggttttgattttattagtagataaatattgattttagttgggtattgtggtttatatttataattttagtattttgggaggttgaggtgggaggattgttagagtttgggaggttaaggttgtagtgagtagtgattatattagtgaattttagtttggatataggttgagtagagatagataattatggggtattttttgggtttttggaaggggtgtggattttgttttgagggtgttggggaattgtaggagagtttggagtaggtgaggagtttgatgagatttttagattttgaaaaatgggttatatttaagtggtgggagtggggtggttgttgagtggggggaggggggtggatttggaaagtattttggaatttttaaggaggtttggagtgaaggtttttgtagagtgtgtaggattattttttgttttagtggagggaattgtgagtttggagaggaaaagtagtagagtggggagaattaggttatattttttttgattgtgattttaatgatagaagtgggtagtaggattttaggatgtgagttaggaagggtttaaggttgtggtagataatgtgagtagaatgtgtaggaatgggagagtggtggtagtgttggggtgttgttttttgttttttggttttttgggagatgtagtaggggttggggtgagaagttgtgagttgttgtgattgtagtatgatttgttgggtggttttggatattaattttttttttgtgagttaggagtgatagtgggatttgaatttatgttatggggagttagaatttgtttttgaattttaattttgtatttaataagtgtaaaaaggttagttttggtggtttatgtttgtaattttagtattttgggaggttaagttaggaagatggttggaggttaggagttggagattagtttgaataatatagtgagattttaattttataattttgtttgtttgtttgtttgttgtatttttagtagagaaggggttttattatgttggttaggttggttttgaatttttgattttatatgatttatttatttttgttttttaaagtgttaggattataggtgtgagttattat

SEQ ID NO: 1121 - DNA, 20 bp, Artificial Sequence
  chemically treated genomic DNA (Homo sapiens)
gggattatttttataaggtt

SEQ ID NO: 1122 - DNA, 21 bp, Artificial Sequence
  chemically treated genomic DNA (Homo sapiens)
cccatactaaaaactctaaac

SEQ ID NO: 1123 - DNA, 33 bp, Artificial Sequence
  chemically treated genomic DNA (Homo sapiens)
ctaaaccccatccccaaaaacacaaaccacaca

SEQ ID NO: 1124 - DNA, 20 bp, Artificial Sequence
  chemically treated genomic DNA (Homo sapiens)
tagtgagtacgcgcggttcg

SEQ ID NO: 1125 - DNA, 24 bp, Artificial Sequence
  chemically treated genomic DNA (Homo sapiens)
agtttcgtcgtcgtagttttcgtt

SEQ ID NO: 1126 - DNA, 20 bp, Artificial Sequence
  chemically treated genomic DNA (Homo sapiens)
gggattatttttataaggtt

SEQ ID NO: 1127 - DNA, 21 bp, Artificial Sequence
  chemically treated genomic DNA (Homo sapiens)
cccatactaaaaactctaaac

SEQ ID NO: 1128 - DNA, 33 bp, Artificial Sequence; identical to SEQ ID NO: 1123
  chemically treated genomic DNA (Homo sapiens)

SEQ ID NO: 1129 - DNA, 24 bp, Artificial Sequence
  chemically treated genomic DNA (Homo sapiens)
agtttcgtcgtcgtagttttcgtt

SEQ ID NO: 1130 - DNA, 20 bp, Artificial Sequence
  chemically treated genomic DNA (Homo sapiens)
tagtgagtacgcgcggttcg

SEQ ID NO: 1131 - DNA, 20 bp, Artificial Sequence
  chemically treated genomic DNA (Homo sapiens)
gggattatttttataaggtt

SEQ ID NO: 1132 - DNA, 21 bp, Artificial Sequence
  chemically treated genomic DNA (Homo sapiens)
ccccatactaaaaactctaaa

SEQ ID NO: 1133 - DNA, 33 bp, Artificial Sequence; identical to SEQ ID NO: 1123
  chemically treated genomic DNA (Homo sapiens)

SEQ ID NO: 1134 - DNA, 24 bp, Artificial Sequence
  chemically treated genomic DNA (Homo sapiens)
agtttcgtcgtcgtagttttcgtt

SEQ ID NO: 1135 - DNA, 20 bp, Artificial Sequence
  chemically treated genomic DNA (Homo sapiens)
tagtgagtacgcgcggttcg

SEQ ID NO: 1136 - DNA, 20 bp, Artificial Sequence
  chemically treated genomic DNA (Homo sapiens)
gggattatttttataaggtt

SEQ ID NO: 1137 - DNA, 21 bp, Artificial Sequence
  chemically treated genomic DNA (Homo sapiens)
ccccatactaaaaactctaaa

SEQ ID NO: 1138 - DNA, 33 bp, Artificial Sequence; identical to SEQ ID NO: 1123
  chemically treated genomic DNA (Homo sapiens)

SEQ ID NO: 1139 - DNA, 24 bp, Artificial Sequence
  chemically treated genomic DNA (Homo sapiens)
agtttcgtcgtcgtagttttcgtt

SEQ ID NO: 1140 - DNA, 20 bp, Artificial Sequence
  chemically treated genomic DNA (Homo sapiens)
tagtgagtacgcgcggttcg

SEQ ID NO: 1141 - DNA, 28 bp, Artificial Sequence
  chemically treated genomic DNA (Homo sapiens)
tggttattaattatgtttatttttatag

SEQ ID NO: 1142 - DNA, 24 bp, Artificial Sequence
  chemically treated genomic DNA (Homo sapiens)
accaaatatctaaatactacaacc

SEQ ID NO: 1143 - DNA, 40 bp, Artificial Sequence
  chemically treated genomic DNA (Homo sapiens)
caaccacaaactaccaaaacccatattaaacaacacacaa

SEQ ID NO: 1144 - DNA, 26 bp, Artificial Sequence
  chemically treated genomic DNA (Homo sapiens)
ctatgcgtttaacgtgtttttttgcg

SEQ ID NO: 1145 - DNA, 25 bp, Artificial Sequence
  chemically treated genomic DNA (Homo sapiens)
tggcgggttttacgttttttgtagt

SEQ ID NO: 1146 - DNA, 28 bp, Artificial Sequence
  chemically treated genomic DNA (Homo sapiens)
tggttattaattatgtttatttttatag

SEQ ID NO: 1147 - DNA, 24 bp, Artificial Sequence
  chemically treated genomic DNA (Homo sapiens)
accaaatatctaaatactacaacc

SEQ ID NO: 1148 - DNA, 40 bp, Artificial Sequence
  chemically treated genomic DNA (Homo sapiens)
tacaaccacaaactaccaaaacccatattaaacaacacac

SEQ ID NO: 1149 - DNA, 26 bp, Artificial Sequence
  chemically treated genomic DNA (Homo sapiens)
ctatgcgtttaacgtgtttttttgcg

SEQ ID NO: 1150 - DNA, 25 bp, Artificial Sequence
  chemically treated genomic DNA (Homo sapiens)
tggcgggttttacgttttttgtagt

SEQ ID NO: 1151 - DNA, 21 bp, Artificial Sequence
  chemically treated genomic DNA (Homo sapiens)
gaatgtttttaaattttggtt

SEQ ID NO: 1152 - DNA, 23 bp, Artificial Sequence
  chemically treated genomic DNA (Homo sapiens)
aaaaatcacttacaacactttac

SEQ ID NO: 1153 - DNA, 36 bp, Artificial Sequence
  chemically treated genomic DNA (Homo sapiens)
cactttacaactaaaaactacacacaaacccacaaa

SEQ ID NO: 1154 - DNA, 21 bp, Artificial Sequence
  chemically treated genomic DNA (Homo sapiens)
agggttttgtggttcgggaag

SEQ ID NO: 1155 - DNA, 19 bp, Artificial Sequence
  chemically treated genomic DNA (Homo sapiens)
cgacgcgttaatttcgcgg

SEQ ID NO: 1156 - DNA, 21 bp, Artificial Sequence
  chemically treated genomic DNA (Homo sapiens)
gaatgtttttaaattttggtt

SEQ ID NO: 1157 - DNA, 23 bp, Artificial Sequence
  chemically treated genomic DNA (Homo sapiens)
aaaaatcacttacaacactttac

SEQ ID NO: 1158 - DNA, 41 bp, Artificial Sequence
  chemically treated genomic DNA (Homo sapiens)
ctttacaactaaaaactacacacaaacccacaaaattaaca

SEQ ID NO: 1159 - DNA, 21 bp, Artificial Sequence
  chemically treated genomic DNA (Homo sapiens)
agggttttgtggttcgggaag

SEQ ID NO: 1160 - DNA, 19 bp, Artificial Sequence
  chemically treated genomic DNA (Homo sapiens)
cgacgcgttaatttcgcgg

SEQ ID NO: 1161 - DNA, 21 bp, Artificial Sequence
  chemically treated genomic DNA (Homo sapiens)
gaatgtttttaaattttggtt

SEQ ID NO: 1162 - DNA, 23 bp, Artificial Sequence
  chemically treated genomic DNA (Homo sapiens)
aaaaatcacttacaacactttac

SEQ ID NO: 1163 - DNA, 42 bp, Artificial Sequence
  chemically treated genomic DNA (Homo sapiens)
actttacaactaaaaactacacacaaacccacaaaattaaca

SEQ ID NO: 1164 - DNA, 21 bp, Artificial Sequence
  chemically treated genomic DNA (Homo sapiens)
agggttttgtggttcgggaag

SEQ ID NO: 1165 - DNA, 19 bp, Artificial Sequence
  chemically treated genomic DNA (Homo sapiens)
cgacgcgttaatttcgcgg

SEQ ID NO: 1166 - DNA, 25 bp, Artificial Sequence
  chemically treated genomic DNA (Homo sapiens)
ttttttaggaatatttttagtattt

SEQ ID NO: 1167 - DNA, 17 bp, Artificial Sequence
  chemically treated genomic DNA (Homo sapiens)
ccaaaacatcaccaaac

SEQ ID NO: 1168 - DNA, 33 bp, Artificial Sequence
  chemically treated genomic DNA (Homo sapiens)
caaaccaaccatccaacaccttactcaccacaa

SEQ ID NO: 1169 - DNA, 19 bp, Artificial Sequence
  chemically treated genomic DNA (Homo sapiens)
cttacgtcgtcgcggcgag

SEQ ID NO: 1170 - DNA, 23 bp, Artificial Sequence
  chemically treated genomic DNA (Homo sapiens)
cgtagatgaggtcggagatgcgt

SEQ ID NO: 1171 - DNA, 12501 bp, Homo Sapiens
cctccccagtagctgggattacaggcacacaccaccatggccagataatttttttgtattttcagtacagacggggttttgctatgttggcctggcaggtctcgaactcttggcctcaagtgatctgcctgccttggcctcccaaaatgctgagattacaggcatgagtcaccaagcccagccttctttcttttttttgagacagagcctcaccctgtcacccaggttggagtgcagtggcacgatcttggctcactgcaacctttgcctcccggttgaagtgattcagtctcccaagtagctgggactacagtcacacaccaccatgcccggctaatttttgtatgtttagtagagatagggtttcaccatgttggccaggctgacctcgaattcctgattgcaaatgatccacctgccttggcctcccaaagcattggcattagaggtgtgagccaccgtacttggcttccttttctatttttgagacagagtctcactctgtcactcaggctggagtgcagtggcacgatcttggctcactgcaacctctgcctcccaggttcaagtgatccttctgcctcaccctcccaagtagctgggattacaggtgtgcacctccgtggctagccctccttttcaattggttagtgtcttgtggttttcccacctttccacagtggaaaatggctcaggactgactgacatgaagacaagcccaggggtctacactcaactcaacccttgcacccaagctctgggctaagattttggcgtgctgagcaccacccattttgtaaggaattttgtaaaattttatctgaagcatcactcacaactccactttctttacttaaataaggatttccgccccatttctgccaggcatactgagcttcacagtccctgtttctttttcctggtgcctaggcctggttctctgagcctggtggtcacaccaatggcatctggcacacagttctccgataatggggatacctaggaggttccgagacaccttacagtcctgggttagtaacctggatctctttttccacctctttaggcattttataatctagctttcccccttcctgtgggtaaagtgctcctgaatgcttatggtccaaaacaagacttctttcctatctattcccaaatctttctccagatccaccctagaggaagggaacagaatcttccacattccagcagctggtgacaggccagaacagggaagaggtgagggctcagctggctccatacaggagtgcagatggaggagcaggatctctctctgcctctcaagttttcctaaacatacttctcaattcctggcgaggactcttccctctccacatcctcccctagtctccccaaggagggagcaggagcattcgaacgcggaaatcgaggtgctagtccaaactgctcggtcggctttagtcatagctggataatgcccggctcaggtctaccacaagccatacagctgctttttccgtgttcaacctgtctgtgacagaaaccaagggggccccggcacccagcatctaggcggtggaatcggggtcttacgcacggttccgcgggcaggtccccggccaggacccgcggggagccacgtagccaggagggtggggctgcccaccgacccaggacgcggcaacggaccggggagggcggagctccagcgaccgcttcccctcccgcccgccggcaccccctggctcccacctggtcccggcgcggcctgcgagctagcgaggttcgcgcggtgaagtactgctcgagctccgagtccgagtcctcttggctgcagtagccactgctcgtcgtgctgctccaggtcatttcgaaagaaggcgcctccgcctcgcccatagccgtacccgcccgtcccccagtcctgcgcgtccgtagccgccaaccaccgccccggtcgcgtgcgtgcgtgtacgcgtgtcagtgtgcgcgtgcgcccgggccagagccgcgccgcaaccgttaagactgaaacgtagatcgccgggatctagctcttgtctcattggggcaggaacgccggggcggggacacgcacgcttcgcccccaggaatgacctcatcgctccggagctccactcacagaccccacctaccacagggaacgggggcgggtgccagcgtccgggcaagcgcacaagagtggcctctggccggaggcgagggcgggaaggtgcgggaagtgcgcgtgcgcggagcctgggtcagcctgggcccgggtccgcttgcagcgggtggagtacttgcggagccggcaatccaggctcccctcccagcccccgcgcagaattagcctctctgtgccgccgggaaatcggcaattagaacgctccttgcgcgcggcacccaggcagccctcgagaatgcctgcactgtggcctgcccatcctcgcccttcccatacgccctcggccccgcgctcaccacgttcgtgtcccgctccaccgcgggttcccagcccaggtcccggggcccgcaacagtccaggcagacgagcgcgcggcagcggtagtggcaggtgaacttgcaatctgcagagaggcctggcggtgaggcggaggagctccaggtcggggaaatgtcccggagattgaagggaagccccagggagagggccgctgctcgccaggctccgcaggcccgacctatctcagtgggttacctcacactgctacgcggactctaatgttggccacctgggcgtctggaaaccggccggaaggccacaggcagagaggcctgctcaacagttggatctctatcgcctagcacagaacttcccctttcctcattggcaattaaaaaaacaacaacaaaaaactgcgtcttgcttttgtcacccaggctggagtgcaatggcgcgatttcggctcaccgcaacctccgcctcctgggttcaagcgattcttctgcctcagcctcctgagtacctaggattacaggcgcccgccaccatgcccagctaatttttgtatttttagtagagacggggtttcaccatgttagccaggctggtctcaaactcctgatctcaggtgatccacccgcctcggccttccaaagtgctgggactacaggcttgagccaccgcacccggcccttcactgggaacgtatatggaatacatctgcccatttacttgaaggaaaaactaaacacctttaacctacgtctgccctgtggttgtcacctgtctctactcccctcagaccaagacactggtctctatacactctaatccttcgccttcactctcccctctacccactccagccaggcttgcctcttcctccaggaaactgcccgggacagggtcctcagcgatctgtgtactaccaaatggaatccagtgttccattctccattctcaccccctcagcatcatttgaagcttgctccctttgactcccaggggctacactctcccagttttcctcctaccccctgcagctcctgctcagctcctttgcagattctgactcaacttccatatctcacgatgaagtctgggctcagtcctgatcactggcctggtctgtctacattcatctgccccagatccacggctgaaacactgacctaaaccctcagactagatcctccgtgccagtaccttcactaggatgtctaaaagacgtttcaagtgaacatggccaaaatttaattcccttttcttcagcctcactgctacacttgcccagcttcctctttgcagcaaaaatggccactaggctcccagttactggagacaaaagcccaaacttatctttgatttctcccttgtctctacctctgataaacatgcccaaatcatcctgcttcttatctccatggctactttatttctctttgagaacgctgcaatgtcccagccttgttctttttttttttttttttttttttgagacagagtctcactctgtcgccaaggctggagggcagtggcacgatctcggctcactgcaacctccgcctcctgtgttcaagcaattctcccacctcagcctcccgagtagctgggattacaggcacccgccactacgcctggctcatttttttttattttttagtagacatgaggtttcaccatgttggccaggctggtcttgaactcctgacctcaggtgatccacccgcctccgccttccgaagtgctgggattacaggcatgagccaccgcgctcggccccttgttcattctttgcattctgtcacaactttgtgctccccccagctgaatttgtgatgtcctcttgtaccggatgagagggtctccatgcacacacagacctgggacactatccatccacaagttcctaaataggccagagcagtgatgctcaacccagactccatgttacaataatttggggagtttttaaaatttactgatgcctagggtccactcccagcagttgattcaacaggtctgcggtgggatccaggctagcggggaggactgtaaaagcacccctggtgattccagctggtgtctacccaggggagagcaacctttgcttgctggcgattcccaggggtgcagaaggactgctgggtgtgtggctgcgtgcatattttagcatctgattcactgggtcagaaaagggtgtttgctaaataaagactcaacaaaactcctgcttgcagggggcccaccaaaggttctaaatttttccaggctccctcccataggtggtaatttcccttcaccctaaaggttctggagggggtcatgagtgtttgagaagaggcaagcctgggaagatggactccgaggacagtaggcacaaaccctttctcaagaagggccaaggcattttaaagataagaaacttaaaatcagcgtatttttacatataagcagccacctctgctcatctgtggcccagatacgagtggagtgcgacaagggataaaccattttcgcgcactcttcagcgatggggcgaaagtaacggacctagtcctcgggagctgtccccgccgaccccctctgccgcgacttgacccgcggcgactgcgctgccccttggctgccccttccgctctcgtaggcgcgcggggccactactcacgcgcgcactgcaggcctttgcgcacgacgccccagatgaagtcgccacagaggtcgcaccacgtgtgcgtggcgggccccgcgggctggaagcggtggccacggccagggaccagctgccgtgtggggttgcacgcggtgccccgcgcgatgcgcagcgcgttggcacgctccagccgggtgcggcccttcccagcgcgcccagcgggtgccagctcccgcagctcaatgagctcaggctcccccgacatggcccggttgggcccgtgcttcgctggctttgggcgctagcaagcgcgggccgggcggggccacagggcgggccccgacttcagcgcctcccccaggatccagactgggcggcgggaaggagctgaggagagccgcgcaatggaaacctgggtgcagggactgtggggcccgaaggcggggctgggcgcgctctcgcagagccccccccgccttgcccttccttccctccttcgtcccctcctcacaccccaccccggacggccacaacgacggcgaccgcaaagcaccacgcggagatacccgtgtttctggaggccagctttactgtgctagaggaagagggtccccacatccggccctggccctcctggtccggtttgctgaagcaacacacttggcctacccactgggtggggcaggaagtctcgagccttcacttggggtgaggaggagggagatcggtcagcagctttaccgcccgctctgctctccactgcggagactggggctccggcagaggctggaccgtgatcttgaggttcaggggtgcattctgggtggattcccttggcatgggtggtcggccctcagcaactgcagccctcatttggctctgtcaccctgggctgccaggacacaagtctttccatgcttttcccagtgcttgacttggcactccctgcaggcaggtgggtattgaggatggcaatgcatgtgggggatgtgggagtagggcttagaggtccaaggttctaggataccctcacctgcagcaataccactcattctggcatcgtgagcagcgcttagaagcctctgcactgcagtaagcacagcggggccgctctggagccactgcctctagcacatccagcctgtaggtctcagcccacctgggggaaagtcaggaaggtctgactggccctggaaggtgggggcaccccacccacatccatgcctcctgcatcccctccaccctccctgccatttccacaggccttaccttcgcgcctgcagccgcaggtcctgctctgaggggctgaacacatgctggagctggtgcttggcaattgcctgccacttgcctctgttttctcgctccagccgctcccagatttctgggatctaggagagagaagtggagagtggcaggaaggtgctggtaaagtgggacagtggtcctgagcagctaactttccagtgcctacctgttccaacaccaggtccttcttaggaggctgggtttcagttagggtcagatgggccaggaaactctgcaagtgggccaggttgggcagctggtccagcagtgtgtctgtgaggaaggcccgaagctgcaagggtgtccagtggaggccagtgtgatgcaggtgctggccagggggccaaggaaaaggaaggggctgggttgggctgagaatgcctgtgggggcccatgtcccactagctggtgtgtcacctgaggcccaaggactgaaaagagcactggggttgaggtgggtgggcaaagataaacagcagggacgcagtcggggtaggatggggagggcggtactggggctgtgggggctggtgcggagggagtctgaccttgagtagccgtcccttggcaaaacttgtgaggcagtagcgcgcctgagcctcagggcttagcagcaggttgtacagggcgatccacacttgcccgtccaacttgctcagcttttgctgctctgagggggccacagtatgccaacggctgccctcgaactgctgcagcttgcctggggagaggaaccagcacactgggtgcagacgttgaattctcttcaagtgagccagctgtgggggctgggagactgaccactgcctgggaatgggagaacctgggctgcaggacttgcccaggctatagggctgctgaccccagagcagggtgagcctcagtagtggacacatgggcctggcctgctgcagagctcaggtctaggccaaccttggctgaggcatcctggtatcctcagtgggcttggggacagggtttgtcttcgtgtgtgcaagctgcccccctctatcaaaaagataccctgaagcagtagcctggggcttaggctggtgggggaggaccctacctccttcccgccggctccagggactatgctccagcagttccaccaggaggcagggcaggttgtgtgtgctaagcatacggctcaaggtgctgagagagaggctaggggcagggacgttgtgaaggaggtgagtagaggcaggctacaggcccggtcttccagccctccacagtaggcccaggcccagtcggactgctcacctgtccacacagtctgtgatgtagcgtagtactgagagggccttcagtgcaatctcaaattccatcagctctgcctgcttctgcagctcctgggaggtcacacagtgttcacgctgggccaccctcacctgcgcaggccttggggaacccagacctaggctttcacaaccctaggtaacctcaacccacctgcatggggttgctgtcctgggatccctccccctcaggggggccaccacagccactctgggccaccagcagggtcagtttgcggtggcaatagtctaccaagtccaagacagtgtcttctgctgactcacacacctcctgggaaaaggaggagggaaactttctgtgtctgatgccttccccacacagacacaatctcccttcctgccaggccctgacccggaactgtggcccatgggcagagatagtccctcaccttgtggaagaacactgtctccaagaggttgatgatggaggcctcgtggtgcacctgtcagataaagagaaggacagggcctgaggaagggataggggctaccagctctcctccccggtccagagccctctgaaggagtgagaagaggtatgaaccaggggcccagctcaccaccatgtagatggggaaggtgttctggggcttgaagtcctccaccctgcagaacacagggaacaccttctgcttccacatctccactgcgatcagctcctccaccagtgttgggacctttgaagggtagggtaaaggacagggatgagatgggcctacctttgcctggcaaccctcccatccccggctcagctcaaccctgatatccccaaacactgctgggcccctaaactattccagacccatgagtatccttcctgacttctctcttgcaccttggaccttcattaccagctgctcccaacacctctgtggatgtccctcatgcttatgtgactggctcctgcccagttcccagactgccttgccctgcctgcacctgcacccttatcctctgcccgcccattcaggcatccctttcaagccagcccttctcctcatgccctccctctagtccctgtctgtggtcctccaaagctcttgtgtgccttggcctcactcctactcaggacccttcacagtgccctgttcctatcctatcccctagtatgagttccatctttcttttgcaaaggacctttcttttttttttttttttttttgagacggagtttcactcttgtcacccaggctggagtgcagtggcatgatcttggctctctgtaacctctgcctcccaggttcaagcgattctcctgcctcagcctcccgagtagctgggattacaggtgtgcaccaccatgctctgcaaatttttgtatttttagtagaggtggggtttcaccatgttggccaggctggccttgaactcctgacctcagatgatccacccgtcttggcctcccaaaatgctgggataacaggcatgagctaccatgcccggcttttttttttttttttttggtcaattgatatctcaggtcatctgctggtgacactccctggtccatgttccagccaggcatctccctggtttctaacttccccctttcatgttgggaaggctgcttccttccatgccgaagttccacctccagttaggttatctcccctccctcccgccctccccaacccctccccaccccttccccaccaccagccttacagtcaattcacagatgcctttagcatttgggccttccccttgaagcctaagctgttctaggacctacagctttctccctaatcaactcatgccctgcacccagcctggtgtgccagagtcctgtccaatagggatacaaaatgaaacatgtaacacattcctctttgtccttcagggagaacaggtgtaccaggccagaggggaagggcacacaggggactccggaggggtagagtaggtgaggtatgggggaaggcaggaaccctgcctgtgacctcggggtaccttcccatgggtgaccagcagctcctgaatgggctcgccctggctgactgtggcatcgaggatggcttgcatgttcagcttctccaggttctcatgctgctggttccacctgcctcagagggtaagtgcatgtgcgtccacgtgtgtgcattaggagtggggatgggggctggatcctactgaagcctaacctgatcctgaggggacacagggggctcaggagcagtaatactcctgtctcggaacgctctgctcccccatttgggagcccctccacactgggcagcccctcccccgagtcaggccccagctccccgactcaaggacaatgactccgggactccgcctgacccgggtgcctcacccttcggagcccatctcgcgtagcgggaagctgcgcagaccccgcaccagcacttcagcttccccgggcagcagcagttccaggtctcccatatcgaggccggggtccggcggatcctgggcagcagccggggtggggatgctgtcacattcggggacgacggaccccgacggtgccaaagtctgggacaggacagttgcgggacggttggggagcgtcagttctcgcagccatggaaacgggttagccgcgcctgcgcagtgcggcctgggccccgcccctggaggtggctcgcgcctaaatccgggcgggtctctagcccgcctcgcctacgcgactgccaatcgccatagtatttggattcccagcgctttctcgggctgtggcccacgagtctctcctgagctccagatccttgtggtctggactctgtcctcagacgccaagtccgcctgcacagggatgggggtaaccccgaccccaacagcccctcctgcggctgtggcatcttgacctacccgctgctcttcctcctccttatggcttcttggttcctctatttctcgcgtcccggctccactagttggctcctgaaatactgccagggcgcacgacttctctccatcctccctatgtccagactgtcatcacctgtcatgggtgaactgcggcagccttttctgtagacctacttccacgcttgatcctcatggacagcccggagccttaaaagtgtatatcaggccgggcgcggtggctgacacctgtaatctcagcactttgggaggccgaggcaggcggatcacttgaggtcaggagtttgagaccagcctgggcaacatggtgaaaccctgtctctactaaaagtacaaaaattagacaggtgtggtagcacacacctgtagtcccagctacatgggagactgaggcaggagaatcgcttgagcacaggaggtggagtttgcagtgaggcaagattgcaccaccgcactccagcctggacaacaaagggagaccgtctcaaaaaaaaaaaaaaagcatatagacattactcccttgcgtgagaggggctctgtggctacttctggccctcaaaatgttaggtgggatgccgcttactagcagctctgcaagatctacttcttgtcctctcctgtacctcgggacttggattctttcctctcctccttgcttccctgaacctccctcatacattccaaagaggtttttgcctcagagttttgcactttgcctggaatacttttccttcagggctcagtttacacctcagcatggcctttcttggccatttaatccagagcagtccctgcctccaacccaactcactcttgatcacatctttttttgaaattgagtctcctgtcacctaggctggagtgcagtggcatgatcttggctcactgcaacctctgcctcccaggttcaagtgattctcctgcctcagcttcctgagtagctgggattacaggtgtgcaccaccacacctggctaattttttgtatttttttttagtggagatggggtttcactatgttggccaggctgtttttgaacatctgacctcaggtgatctgcccgcttcagcctcccaaagtgctgggattataggcatgagccaccgcgcctggctacatctgcttctttctaggtttatttattattattattattattgagatggggtcttgctctgtcacccaggctggggtgcagtgatgggatcacagctaaatgtagcctccaactcgtggcctcaaatgatccccccacttcagcctcctgagtagctggggctacaggtgagtcaccgcatcaggacgatttttttttttttttttttttttttttgtaattaaccggcacttttatttgtcgattgtcggtcctgcccaccagatggcgatctagcccacggctcgtggctatttcattcactgctgggtctcccacggctggcccagaaacagcactcaataaaggctgtttgaaatggatgtctttatttacagaactaagagtcaacctctagacagtatgacaagcctcctagtaggagggactacccacagcaatgtgtccatccagtcactaccagcctcacttccagcagatgatgatgttggggtcattttcaagccgctcatccagctcatggtagctcatgcctgggtggggtggtggaggagaggtcagtggccttggcctggccaccctgccctgaacccaccctgactgcccgcctgcctccacctgtcttgcagcagatctcgtcatagctgtggcagcctgtataaagccgggcagggtggctctgctcttcccgagtcacccgcacaggatacttctgtagtcgcctgatgaggttcttcataagcccgaactggatcagcttcctagggtgaggatcagaggacggggtgacgccctg

SEQ ID NO: 1172 - DNA, 12501 bp, Artificial Sequence
  chemically treated genomic DNA (Homo sapiens)
tttttttagtagttgggattataggtatatattattatggttagataatttttttgtatttttagtatagacggggttttgttatgttggtttggtaggtttcgaatttttggttttaagtgatttgtttgttttggttttttaaaatgttgagattataggtatgagttattaagtttagtttttttttttttttttgagatagagttttattttgttatttaggttggagtgtagtggtacgattttggtttattgtaatttttgtttttcggttgaagtgatttagttttttaagtagttgggattatagttatatattattatgttcggttaatttttgtatgtttagtagagatagggttttattatgttggttaggttgatttcgaatttttgattgtaaatgatttatttgttttggttttttaaagtattggtattagaggtgtgagttatcgtatttggtttttttttttatttttgagatagagttttattttgttatttaggttggagtgtagtggtacgattttggtttattgtaatttttgttttttaggtttaagtgatttttttgttttatttttttaagtagttgggattataggtgtgtattttcgtggttagtttttttttttaattggttagtgttttgtggtttttttatttttttatagtggaaaatggtttaggattgattgatatgaagataagtttaggggtttatatttaatttaatttttgtatttaagttttgggttaagattttggcgtgttgagtattatttattttgtaaggaattttgtaaaattttatttgaagtattatttataattttattttttttatttaaataaggattttcgttttatttttgttaggtatattgagttttatagtttttgttttttttttttggtgtttaggtttggttttttgagtttggtggttatattaatggtatttggtatatagtttttcgataatggggatatttaggaggtttcgagatattttatagttttgggttagtaatttggatttttttttttatttttttaggtattttataatttagttttttttttttttgtgggtaaagtgtttttgaatgtttatggtttaaaataagattttttttttatttatttttaaatttttttttagatttattttagaggaagggaatagaattttttatattttagtagttggtgataggttagaatagggaagaggtgagggtttagttggttttatataggagtgtagatggaggagtaggatttttttttgttttttaagtttttttaaatatattttttaatttttggcgaggatttttttttttttatatttttttttagtttttttaaggagggagtaggagtattcgaacgcggaaatcgaggtgttagtttaaattgttcggtcggttttagttatagttggataatgttcggtttaggtttattataagttatatagttgtttttttcgtgtttaatttgtttgtgatagaaattaagggggtttcggtatttagtatttaggcggtggaatcggggttttacgtacggtttcgcgggtaggttttcggttaggattcgcggggagttacgtagttaggagggtggggttgtttatcgatttaggacgcggtaacggatcggggagggcggagttttagcgatcgttttttttttcgttcgtcggtattttttggtttttatttggtttcggcgcggtttgcgagttagcgaggttcgcgcggtgaagtattgttcgagtttcgagttcgagtttttttggttgtagtagttattgttcgtcgtgttgttttaggttatttcgaaagaaggcgttttcgtttcgtttatagtcgtattcgttcgttttttagttttgcgcgttcgtagtcgttaattatcgtttcggtcgcgtgcgtgcgtgtacgcgtgttagtgtgcgcgtgcgttcgggttagagtcgcgtcgtaatcgttaagattgaaacgtagatcgtcgggatttagtttttgttttattggggtaggaacgtcggggcggggatacgtacgtttcgtttttaggaatgattttatcgtttcggagttttatttatagattttatttattatagggaacgggggcgggtgttagcgttcgggtaagcgtataagagtggtttttggtcggaggcgagggcgggaaggtgcgggaagtgcgcgtgcgcggagtttgggttagtttgggttcgggttcgtttgtagcgggtggagtatttgcggagtcggtaatttaggttttttttttagttttcgcgtagaattagtttttttgtgtcgtcgggaaatcggtaattagaacgttttttgcgcgcggtatttaggtagttttcgagaatgtttgtattgtggtttgtttattttcgttttttttatacgttttcggtttcgcgtttattacgttcgtgtttcgttttatcgcgggtttttagtttaggtttcggggttcgtaatagtttaggtagacgagcgcgcggtagcggtagtggtaggtgaatttgtaatttgtagagaggtttggcggtgaggcggaggagttttaggtcggggaaatgtttcggagattgaagggaagttttagggagagggtcgttgttcgttaggtttcgtaggttcgatttattttagtgggttattttatattgttacgcggattttaatgttggttatttgggcgtttggaaatcggtcggaaggttataggtagagaggtttgtttaatagttggatttttatcgtttagtatagaattttttttttttttattggtaattaaaaaaataataataaaaaattgcgttttgtttttgttatttaggttggagtgtaatggcgcgatttcggtttatcgtaattttcgttttttgggtttaagcgatttttttgttttagttttttgagtatttaggattataggcgttcgttattatgtttagttaatttttgtatttttagtagagacggggttttattatgttagttaggttggttttaaatttttgattttaggtgatttattcgtttcggttttttaaagtgttgggattataggtttgagttatcgtattcggttttttattgggaacgtatatggaatatatttgtttatttatttgaaggaaaaattaaatatttttaatttacgtttgttttgtggttgttatttgtttttattttttttagattaagatattggtttttatatattttaatttttcgtttttatttttttttttatttattttagttaggtttgtttttttttttaggaaattgttcgggatagggtttttagcgatttgtgtattattaaatggaatttagtgttttattttttatttttatttttttagtattatttgaagtttgttttttttgatttttaggggttatatttttttagttttttttttattttttgtagtttttgtttagtttttttgtagattttgatttaatttttatattttacgatgaagtttgggtttagttttgattattggtttggtttgtttatatttatttgttttagatttacggttgaaatattgatttaaatttttagattagatttttcgtgttagtatttttattaggatgtttaaaagacgttttaagtgaatatggttaaaatttaatttttttttttttagttttattgttatatttgtttagttttttttttgtagtaaaaatggttattaggtttttagttattggagataaaagtttaaatttatttttgattttttttttgtttttatttttgataaatatgtttaaattattttgttttttatttttatggttattttatttttttttgagaacgttgtaatgttttagttttgttttttttttttttttttttttttttgagatagagttttattttgtcgttaaggttggagggtagtggtacgatttcggtttattgtaattttcgttttttgtgtttaagtaatttttttattttagtttttcgagtagttgggattataggtattcgttattacgtttggtttatttttttttattttttagtagatatgaggttttattatgttggttaggttggttttgaatttttgattttaggtgatttattcgttttcgtttttcgaagtgttgggattataggtatgagttatcgcgttcggttttttgtttattttttgtattttgttataattttgtgttttttttagttgaatttgtgatgtttttttgtatcggatgagagggtttttatgtatatatagatttgggatattatttatttataagtttttaaataggttagagtagtgatgtttaatttagattttatgttataataatttggggagtttttaaaatttattgatgtttagggtttatttttagtagttgatttaataggtttgcggtgggatttaggttagcggggaggattgtaaaagtatttttggtgattttagttggtgtttatttaggggagagtaatttttgtttgttggcgatttttaggggtgtagaaggattgttgggtgtgtggttgcgtgtatattttagtatttgatttattgggttagaaaagggtgtttgttaaataaagatttaataaaatttttgtttgtagggggtttattaaaggttttaaatttttttaggtttttttttataggtggtaatttttttttattttaaaggttttggagggggttatgagtgtttgagaagaggtaagtttgggaagatggatttcgaggatagtaggtataaatttttttttaagaagggttaaggtattttaaagataagaaatttaaaattagcgtatttttatatataagtagttatttttgtttatttgtggtttagatacgagtggagtgcgataagggataaattattttcgcgtattttttagcgatggggcgaaagtaacggatttagttttcgggagttgttttcgtcgattttttttgtcgcgatttgattcgcggcgattgcgttgttttttggttgtttttttcgttttcgtaggcgcgcggggttattatttacgcgcgtattgtaggtttttgcgtacgacgttttagatgaagtcgttatagaggtcgtattacgtgtgcgtggcgggtttcgcgggttggaagcggtggttacggttagggattagttgtcgtgtggggttgtacgcggtgtttcgcgcgatgcgtagcgcgttggtacgttttagtcgggtgcggttttttttagcgcgtttagcgggtgttagttttcgtagtttaatgagtttaggttttttcgatatggttcggttgggttcgtgtttcgttggttttgggcgttagtaagcgcgggtcgggcggggttatagggcgggtttcgattttagcgttttttttaggatttagattgggcggcgggaaggagttgaggagagtcgcgtaatggaaatttgggtgtagggattgtggggttcgaaggcggggttgggcgcgttttcgtagagtttttttcgttttgtttttttttttttttttcgttttttttttatattttatttcggacggttataacgacggcgatcgtaaagtattacgcggagatattcgtgtttttggaggttagttttattgtgttagaggaagagggtttttatattcggttttggtttttttggttcggtttgttgaagtaatatatttggtttatttattgggtggggtaggaagtttcgagtttttatttggggtgaggaggagggagatcggttagtagttttatcgttcgttttgttttttattgcggagattggggtttcggtagaggttggatcgtgattttgaggtttaggggtgtattttgggtggatttttttggtatgggtggtcggtttttagtaattgtagtttttatttggttttgttattttgggttgttaggatataagtttttttatgttttttttagtgtttgatttggtattttttgtaggtaggtgggtattgaggatggtaatgtatgtgggggatgtgggagtagggtttagaggtttaaggttttaggatatttttatttgtagtaatattatttattttggtatcgtgagtagcgtttagaagtttttgtattgtagtaagtatagcggggtcgttttggagttattgtttttagtatatttagtttgtaggttttagtttatttgggggaaagttaggaaggtttgattggttttggaaggtgggggtattttatttatatttatgttttttgtattttttttattttttttgttatttttataggttttattttcgcgtttgtagtcgtaggttttgttttgaggggttgaatatatgttggagttggtgtttggtaattgtttgttatttgtttttgttttttcgttttagtcgtttttagatttttgggatttaggagagagaagtggagagtggtaggaaggtgttggtaaagtgggatagtggttttgagtagttaattttttagtgtttatttgttttaatattaggttttttttaggaggttgggttttagttagggttagatgggttaggaaattttgtaagtgggttaggttgggtagttggtttagtagtgtgtttgtgaggaaggttcgaagttgtaagggtgtttagtggaggttagtgtgatgtaggtgttggttagggggttaaggaaaaggaaggggttgggttgggttgagaatgtttgtgggggtttatgttttattagttggtgtgttatttgaggtttaaggattgaaaagagtattggggttgaggtgggtgggtaaagataaatagtagggacgtagtcggggtaggatggggagggcggtattggggttgtgggggttggtgcggagggagtttgattttgagtagtcgttttttggtaaaatttgtgaggtagtagcgcgtttgagttttagggtttagtagtaggttgtatagggcgatttatatttgttcgtttaatttgtttagtttttgttgttttgagggggttatagtatgttaacggttgttttcgaattgttgtagtttgtttggggagaggaattagtatattgggtgtagacgttgaattttttttaagtgagttagttgtgggggttgggagattgattattgtttgggaatgggagaatttgggttgtaggatttgtttaggttatagggttgttgattttagagtagggtgagttttagtagtggatatatgggtttggtttgttgtagagtttaggtttaggttaattttggttgaggtattttggtatttttagtgggtttggggatagggtttgttttcgtgtgtgtaagttgtttttttttattaaaaagatattttgaagtagtagtttggggtttaggttggtgggggaggattttatttttttttcgtcggttttagggattatgttttagtagttttattaggaggtagggtaggttgtgtgtgttaagtatacggtttaaggtgttgagagagaggttaggggtagggacgttgtgaaggaggtgagtagaggtaggttataggttcggttttttagttttttatagtaggtttaggtttagtcggattgtttatttgtttatatagtttgtgatgtagcgtagtattgagagggtttttagtgtaattttaaattttattagttttgtttgtttttgtagtttttgggaggttatatagtgtttacgttgggttatttttatttgcgtaggttttggggaatttagatttaggtttttataattttaggtaattttaatttatttgtatggggttgttgttttgggattttttttttttaggggggttattatagttattttgggttattagtagggttagtttgcggtggtaatagtttattaagtttaagatagtgttttttgttgatttatatattttttgggaaaaggaggagggaaattttttgtgtttgatgttttttttatatagatataatttttttttttgttaggttttgattcggaattgtggtttatgggtagagatagttttttattttgtggaagaatattgtttttaagaggttgatgatggaggtttcgtggtgtatttgttagataaagagaaggatagggtttgaggaagggataggggttattagttttttttttcggtttagagttttttgaaggagtgagaagaggtatgaattaggggtttagtttattattatgtagatggggaaggtgttttggggtttgaagttttttattttgtagaatatagggaatattttttgtttttatatttttattgcgattagtttttttattagtgttgggatttttgaagggtagggtaaaggatagggatgagatgggtttatttttgtttggtaatttttttattttcggtttagtttaattttgatatttttaaatattgttgggtttttaaattattttagatttatgagtattttttttgattttttttttgtattttggatttttattattagttgtttttaatatttttgtggatgttttttatgtttatgtgattggtttttgtttagtttttagattgttttgttttgtttgtatttgtatttttattttttgttcgtttatttaggtattttttttaagttagtttttttttttatgttttttttttagtttttgtttgtggttttttaaagtttttgtgtgttttggttttatttttatttaggattttttatagtgttttgtttttattttattttttagtatgagttttattttttttttgtaaaggattttttttttttttttttttttttttgagacggagttttatttttgttatttaggttggagtgtagtggtatgattttggttttttgtaatttttgttttttaggtttaagcgatttttttgttttagtttttcgagtagttgggattataggtgtgtattattatgttttgtaaatttttgtatttttagtagaggtggggttttattatgttggttaggttggttttgaatttttgattttagatgatttattcgttttggttttttaaaatgttgggataataggtatgagttattatgttcggtttttttttttttttttttggttaattgatattttaggttatttgttggtgatattttttggtttatgttttagttaggtatttttttggtttttaattttttttttttatgttgggaaggttgtttttttttatgtcgaagttttatttttagttaggttattttttttttttttcgttttttttaatttttttttattttttttttattattagttttatagttaatttatagatgtttttagtatttgggttttttttttgaagtttaagttgttttaggatttatagttttttttttaattaatttatgttttgtatttagtttggtgtgttagagttttgtttaatagggatataaaatgaaatatgtaatatatttttttttgttttttagggagaataggtgtattaggttagaggggaagggtatataggggatttcggaggggtagagtaggtgaggtatgggggaaggtaggaattttgtttgtgatttcggggtatttttttatgggtgattagtagtttttgaatgggttcgttttggttgattgtggtatcgaggatggtttgtatgtttagtttttttaggtttttatgttgttggttttatttgttttagagggtaagtgtatgtgcgtttacgtgtgtgtattaggagtggggatgggggttggattttattgaagtttaatttgattttgaggggatatagggggtttaggagtagtaatatttttgtttcggaacgttttgtttttttatttgggagtttttttatattgggtagtttttttttcgagttaggttttagtttttcgatttaaggataatgatttcgggatttcgtttgattcgggtgttttatttttcggagtttatttcgcgtagcgggaagttgcgtagatttcgtattagtattttagttttttcgggtagtagtagttttaggttttttatatcgaggtcggggttcggcggattttgggtagtagtcggggtggggatgttgttatattcggggacgacggatttcgacggtgttaaagtttgggataggatagttgcgggacggttggggagcgttagttttcgtagttatggaaacgggttagtcgcgtttgcgtagtgcggtttgggtttcgtttttggaggtggttcgcgtttaaattcgggcgggtttttagttcgtttcgtttacgcgattgttaatcgttatagtatttggatttttagcgttttttcgggttgtggtttacgagttttttttgagttttagatttttgtggtttggattttgtttttagacgttaagttcgtttgtatagggatgggggtaatttcgattttaatagttttttttgcggttgtggtattttgatttattcgttgtttttttttttttttatggttttttggtttttttatttttcgcgtttcggttttattagttggtttttgaaatattgttagggcgtacgatttttttttattttttttatgtttagattgttattatttgttatgggtgaattgcggtagttttttttgtagatttatttttacgtttgatttttatggatagttcggagttttaaaagtgtatattaggtcgggcgcggtggttgatatttgtaattttagtattttgggaggtcgaggtaggcggattatttgaggttaggagtttgagattagtttgggtaatatggtgaaattttgtttttattaaaagtataaaaattagataggtgtggtagtatatatttgtagttttagttatatgggagattgaggtaggagaatcgtttgagtataggaggtggagtttgtagtgaggtaagattgtattatcgtattttagtttggataataaagggagatcgttttaaaaaaaaaaaaaaagtatatagatattatttttttgcgtgagaggggttttgtggttatttttggtttttaaaatgttaggtgggatgtcgtttattagtagttttgtaagatttattttttgtttttttttgtatttcgggatttggattttttttttttttttttgtttttttgaattttttttatatattttaaagaggtttttgttttagagttttgtattttgtttggaatattttttttttagggtttagtttatattttagtatggttttttttggttatttaatttagagtagtttttgtttttaatttaatttatttttgattatatttttttttgaaattgagttttttgttatttaggttggagtgtagtggtatgattttggtttattgtaatttttgttttttaggtttaagtgatttttttgttttagttttttgagtagttgggattataggtgtgtattattatatttggttaattttttgtatttttttttagtggagatggggttttattatgttggttaggttgtttttgaatatttgattttaggtgatttgttcgttttagttttttaaagtgttgggattataggtatgagttatcgcgtttggttatatttgtttttttttaggtttatttattattattattattattgagatggggttttgttttgttatttaggttggggtgtagtgatgggattatagttaaatgtagtttttaattcgtggttttaaatgatttttttattttagttttttgagtagttggggttataggtgagttatcgtattaggacgatttttttttttttttttttttttttttgtaattaatcggtatttttatttgtcgattgtcggttttgtttattagatggcgatttagtttacggttcgtggttattttatttattgttgggttttttacggttggtttagaaatagtatttaataaaggttgtttgaaatggatgtttttatttatagaattaagagttaatttttagatagtatgataagttttttagtaggagggattatttatagtaatgtgtttatttagttattattagttttatttttagtagatgatgatgttggggttatttttaagtcgtttatttagtttatggtagtttatgtttgggtggggtggtggaggagaggttagtggttttggtttggttattttgttttgaatttattttgattgttcgtttgtttttatttgttttgtagtagatttcgttatagttgtggtagtttgtataaagtcgggtagggtggttttgtttttttcgagttattcgtataggatatttttgtagtcgtttgatgaggttttttataagttcgaattggattagttttttagggtgaggattagaggacggggtgacgttttg

SEQ ID NO: 1173 - DNA, 12501 bp, Artificial Sequence
  chemically treated genomic DNA (Homo sapiens)
tagggcgttatttcgttttttgatttttattttaggaagttgatttagttcgggtttatgaagaattttattaggcgattatagaagtattttgtgcgggtgattcgggaagagtagagttattttgttcggttttatataggttgttatagttatgacgagatttgttgtaagataggtggaggtaggcgggtagttagggtgggtttagggtagggtggttaggttaaggttattgattttttttttattattttatttaggtatgagttattatgagttggatgagcggtttgaaaatgattttaatattattatttgttggaagtgaggttggtagtgattggatggatatattgttgtgggtagttttttttattaggaggtttgttatattgtttagaggttgatttttagttttgtaaataaagatatttattttaaatagtttttattgagtgttgtttttgggttagtcgtgggagatttagtagtgaatgaaatagttacgagtcgtgggttagatcgttatttggtgggtaggatcgataatcgataaataaaagtgtcggttaattataaaaaaaaaaaaaaaaaaaaaaaaaaatcgttttgatgcggtgatttatttgtagttttagttatttaggaggttgaagtggggggattatttgaggttacgagttggaggttatatttagttgtgattttattattgtattttagtttgggtgatagagtaagattttattttaataataataataataataaataaatttagaaagaagtagatgtagttaggcgcggtggtttatgtttataattttagtattttgggaggttgaagcgggtagattatttgaggttagatgtttaaaaatagtttggttaatatagtgaaattttatttttattaaaaaaaaatataaaaaattagttaggtgtggtggtgtatatttgtaattttagttatttaggaagttgaggtaggagaattatttgaatttgggaggtagaggttgtagtgagttaagattatgttattgtattttagtttaggtgataggagatttaattttaaaaaaagatgtgattaagagtgagttgggttggaggtagggattgttttggattaaatggttaagaaaggttatgttgaggtgtaaattgagttttgaaggaaaagtattttaggtaaagtgtaaaattttgaggtaaaaatttttttggaatgtatgagggaggtttagggaagtaaggaggagaggaaagaatttaagtttcgaggtataggagaggataagaagtagattttgtagagttgttagtaagcggtattttatttaatattttgagggttagaagtagttatagagttttttttacgtaagggagtaatgtttatatgttttttttttttttttgagacggtttttttttgttgtttaggttggagtgcggtggtgtaattttgttttattgtaaattttattttttgtgtttaagcgatttttttgttttagttttttatgtagttgggattataggtgtgtgttattatatttgtttaatttttgtatttttagtagagatagggttttattatgttgtttaggttggttttaaatttttgattttaagtgattcgtttgtttcggttttttaaagtgttgagattataggtgttagttatcgcgttcggtttgatatatatttttaaggtttcgggttgtttatgaggattaagcgtggaagtaggtttatagaaaaggttgtcgtagtttatttatgataggtgatgatagtttggatatagggaggatggagagaagtcgtgcgttttggtagtattttaggagttaattagtggagtcgggacgcgagaaatagaggaattaagaagttataaggaggaggaagagtagcgggtaggttaagatgttatagtcgtaggaggggttgttggggtcggggttatttttatttttgtgtaggcggatttggcgtttgaggatagagtttagattataaggatttggagtttaggagagattcgtgggttatagttcgagaaagcgttgggaatttaaatattatggcgattggtagtcgcgtaggcgaggcgggttagagattcgttcggatttaggcgcgagttatttttaggggcggggtttaggtcgtattgcgtaggcgcggttaattcgtttttatggttgcgagaattgacgttttttaatcgtttcgtaattgttttgttttagattttggtatcgtcggggttcgtcgttttcgaatgtgatagtatttttatttcggttgttgtttaggattcgtcggatttcggtttcgatatgggagatttggaattgttgttgttcggggaagttgaagtgttggtgcggggtttgcgtagtttttcgttacgcgagatgggtttcgaagggtgaggtattcgggttaggcggagtttcggagttattgtttttgagtcggggagttggggtttgattcgggggaggggttgtttagtgtggaggggtttttaaatgggggagtagagcgtttcgagataggagtattattgtttttgagttttttgtgtttttttaggattaggttaggttttagtaggatttagtttttatttttatttttaatgtatatacgtggacgtatatgtatttattttttgaggtaggtggaattagtagtatgagaatttggagaagttgaatatgtaagttattttcgatgttatagttagttagggcgagtttatttaggagttgttggttatttatgggaaggtatttcgaggttataggtagggtttttgtttttttttatattttatttattttattttttcggagttttttgtgtgttttttttttttggtttggtatatttgttttttttgaaggataaagaggaatgtgttatatgttttattttgtatttttattggataggattttggtatattaggttgggtgtagggtatgagttgattagggagaaagttgtaggttttagaatagtttaggttttaaggggaaggtttaaatgttaaaggtatttgtgaattgattgtaaggttggtggtggggaaggggtggggaggggttggggagggcgggagggaggggagataatttaattggaggtggaatttcggtatggaaggaagtagtttttttaatatgaaagggggaagttagaaattagggagatgtttggttggaatatggattagggagtgttattagtagatgatttgagatattaattgattaaaaaaaaaaaaaaaaaagtcgggtatggtagtttatgtttgttattttagtattttgggaggttaagacgggtggattatttgaggttaggagtttaaggttagtttggttaatatggtgaaattttatttttattaaaaatataaaaatttgtagagtatggtggtgtatatttgtaattttagttattcgggaggttgaggtaggagaatcgtttgaatttgggaggtagaggttatagagagttaagattatgttattgtattttagtttgggtgataagagtgaaatttcgttttaaaaaaaaaaaaaaaaaaaagaaaggttttttgtaaaagaaagatggaatttatattaggggataggataggaatagggtattgtgaagggttttgagtaggagtgaggttaaggtatataagagttttggaggattatagatagggattagagggagggtatgaggagaagggttggtttgaaagggatgtttgaatgggcgggtagaggataagggtgtaggtgtaggtagggtaaggtagtttgggaattgggtaggagttagttatataagtatgagggatatttatagaggtgttgggagtagttggtaatgaaggtttaaggtgtaagagagaagttaggaaggatatttatgggtttggaatagtttaggggtttagtagtgtttggggatattagggttgagttgagtcggggatgggagggttgttaggtaaaggtaggtttattttatttttgttttttattttattttttaaaggttttaatattggtggaggagttgatcgtagtggagatgtggaagtagaaggtgttttttgtgttttgtagggtggaggattttaagttttagaatattttttttatttatatggtggtgagttgggtttttggtttatatttttttttatttttttagagggttttggatcggggaggagagttggtagtttttattttttttttaggttttgtttttttttttatttgataggtgtattacgaggtttttattattaattttttggagatagtgtttttttataaggtgagggattatttttgtttatgggttatagtttcgggttagggtttggtaggaagggagattgtgtttgtgtggggaaggtattagatatagaaagtttttttttttttttttttaggaggtgtgtgagttagtagaagatattgttttggatttggtagattattgttatcgtaaattgattttgttggtggtttagagtggttgtggtggtttttttgagggggagggattttaggatagtaattttatgtaggtgggttgaggttatttagggttgtgaaagtttaggtttgggttttttaaggtttgcgtaggtgagggtggtttagcgtgaatattgtgtgattttttaggagttgtagaagtaggtagagttgatggaatttgagattgtattgaaggtttttttagtattacgttatattatagattgtgtggataggtgagtagttcgattgggtttgggtttattgtggagggttggaagatcgggtttgtagtttgtttttatttattttttttataacgtttttgtttttagttttttttttagtattttgagtcgtatgtttagtatatataatttgttttgttttttggtggaattgttggagtatagtttttggagtcggcgggaaggaggtagggtttttttttattagtttaagttttaggttattgttttagggtatttttttgatagaggggggtagtttgtatatacgaagataaattttgtttttaagtttattgaggatattaggatgttttagttaaggttggtttagatttgagttttgtagtaggttaggtttatgtgtttattattgaggtttattttgttttggggttagtagttttatagtttgggtaagttttgtagtttaggtttttttatttttaggtagtggttagttttttagtttttatagttggtttatttgaagagaatttaacgtttgtatttagtgtgttggtttttttttttaggtaagttgtagtagttcgagggtagtcgttggtatattgtggtttttttagagtagtaaaagttgagtaagttggacgggtaagtgtggatcgttttgtataatttgttgttaagttttgaggtttaggcgcgttattgttttataagttttgttaagggacggttatttaaggttagatttttttcgtattagtttttatagttttagtatcgttttttttattttatttcgattgcgtttttgttgtttatttttgtttatttattttaattttagtgttttttttagtttttgggttttaggtgatatattagttagtgggatatgggtttttataggtatttttagtttaatttagttttttttttttttttggttttttggttagtatttgtattatattggtttttattggatatttttgtagtttcgggttttttttatagatatattgttggattagttgtttaatttggtttatttgtagagttttttggtttatttgattttaattgaaatttagttttttaagaaggatttggtgttggaataggtaggtattggaaagttagttgtttaggattattgttttattttattagtatttttttgttattttttattttttttttttagattttagaaatttgggagcggttggagcgagaaaatagaggtaagtggtaggtaattgttaagtattagttttagtatgtgtttagttttttagagtaggatttgcggttgtaggcgcgaaggtaaggtttgtggaaatggtagggagggtggaggggatgtaggaggtatggatgtgggtggggtgtttttattttttagggttagttagatttttttgatttttttttaggtgggttgagatttataggttggatgtgttagaggtagtggttttagagcggtttcgttgtgtttattgtagtgtagaggtttttaagcgttgtttacgatgttagaatgagtggtattgttgtaggtgagggtattttagaattttggatttttaagttttatttttatattttttatatgtattgttatttttaatatttatttgtttgtagggagtgttaagttaagtattgggaaaagtatggaaagatttgtgttttggtagtttagggtgatagagttaaatgagggttgtagttgttgagggtcgattatttatgttaagggaatttatttagaatgtatttttgaattttaagattacggtttagtttttgtcggagttttagttttcgtagtggagagtagagcgggcggtaaagttgttgatcgattttttttttttttattttaagtgaaggttcgagattttttgttttatttagtgggtaggttaagtgtgttgttttagtaaatcggattaggagggttagggtcggatgtggggattttttttttttagtatagtaaagttggtttttagaaatacgggtattttcgcgtggtgttttgcggtcgtcgtcgttgtggtcgttcggggtggggtgtgaggaggggacgaaggagggaaggaagggtaaggcggggggggttttgcgagagcgcgtttagtttcgttttcgggttttatagtttttgtatttaggtttttattgcgcggttttttttagttttttttcgtcgtttagtttggattttgggggaggcgttgaagtcggggttcgttttgtggtttcgttcggttcgcgtttgttagcgtttaaagttagcgaagtacgggtttaatcgggttatgtcgggggagtttgagtttattgagttgcgggagttggtattcgttgggcgcgttgggaagggtcgtattcggttggagcgtgttaacgcgttgcgtatcgcgcggggtatcgcgtgtaattttatacggtagttggtttttggtcgtggttatcgtttttagttcgcggggttcgttacgtatacgtggtgcgatttttgtggcgattttatttggggcgtcgtgcgtaaaggtttgtagtgcgcgcgtgagtagtggtttcgcgcgtttacgagagcggaaggggtagttaaggggtagcgtagtcgtcgcgggttaagtcgcggtagagggggtcggcggggatagttttcgaggattaggttcgttattttcgttttatcgttgaagagtgcgcgaaaatggtttattttttgtcgtattttattcgtatttgggttatagatgagtagaggtggttgtttatatgtaaaaatacgttgattttaagttttttatttttaaaatgttttggttttttttgagaaagggtttgtgtttattgttttcggagtttatttttttaggtttgtttttttttaaatatttatgattttttttagaatttttagggtgaagggaaattattatttatgggagggagtttggaaaaatttagaatttttggtgggttttttgtaagtaggagttttgttgagtttttatttagtaaatatttttttttgatttagtgaattagatgttaaaatatgtacgtagttatatatttagtagtttttttgtatttttgggaatcgttagtaagtaaaggttgtttttttttgggtagatattagttggaattattaggggtgtttttatagtttttttcgttagtttggattttatcgtagatttgttgaattaattgttgggagtggattttaggtattagtaaattttaaaaattttttaaattattgtaatatggagtttgggttgagtattattgttttggtttatttaggaatttgtggatggatagtgttttaggtttgtgtgtgtatggagatttttttattcggtataagaggatattataaatttagttggggggagtataaagttgtgatagaatgtaaagaatgaataaggggtcgagcgcggtggtttatgtttgtaattttagtatttcggaaggcggaggcgggtggattatttgaggttaggagtttaagattagtttggttaatatggtgaaattttatgtttattaaaaaataaaaaaaaatgagttaggcgtagtggcgggtgtttgtaattttagttattcgggaggttgaggtgggagaattgtttgaatataggaggcggaggttgtagtgagtcgagatcgtgttattgttttttagttttggcgatagagtgagattttgttttaaaaaaaaaaaaaaaaaaaaaaagaataaggttgggatattgtagcgtttttaaagagaaataaagtagttatggagataagaagtaggatgatttgggtatgtttattagaggtagagataagggagaaattaaagataagtttgggtttttgtttttagtaattgggagtttagtggttatttttgttgtaaagaggaagttgggtaagtgtagtagtgaggttgaagaaaagggaattaaattttggttatgtttatttgaaacgttttttagatattttagtgaaggtattggtacggaggatttagtttgagggtttaggttagtgttttagtcgtggatttggggtagatgaatgtagatagattaggttagtgattaggattgagtttagattttatcgtgagatatggaagttgagttagaatttgtaaaggagttgagtaggagttgtagggggtaggaggaaaattgggagagtgtagtttttgggagttaaagggagtaagttttaaatgatgttgagggggtgagaatggagaatggaatattggattttatttggtagtatatagatcgttgaggattttgtttcgggtagttttttggaggaagaggtaagtttggttggagtgggtagaggggagagtgaaggcgaaggattagagtgtatagagattagtgttttggtttgaggggagtagagataggtgataattatagggtagacgtaggttaaaggtgtttagttttttttttaagtaaatgggtagatgtattttatatacgtttttagtgaagggtcgggtgcggtggtttaagtttgtagttttagtattttggaaggtcgaggcgggtggattatttgagattaggagtttgagattagtttggttaatatggtgaaatttcgtttttattaaaaatataaaaattagttgggtatggtggcgggcgtttgtaattttaggtatttaggaggttgaggtagaagaatcgtttgaatttaggaggcggaggttgcggtgagtcgaaatcgcgttattgtattttagtttgggtgataaaagtaagacgtagttttttgttgttgtttttttaattgttaatgaggaaaggggaagttttgtgttaggcgatagagatttaattgttgagtaggtttttttgtttgtggtttttcggtcggtttttagacgtttaggtggttaatattagagttcgcgtagtagtgtgaggtaatttattgagataggtcgggtttgcggagtttggcgagtagcggttttttttttggggtttttttttaattttcgggatattttttcgatttggagttttttcgttttatcgttaggtttttttgtagattgtaagtttatttgttattatcgttgtcgcgcgttcgtttgtttggattgttgcgggtttcgggatttgggttgggaattcgcggtggagcgggatacgaacgtggtgagcgcggggtcgagggcgtatgggaagggcgaggatgggtaggttatagtgtaggtattttcgagggttgtttgggtgtcgcgcgtaaggagcgttttaattgtcgatttttcggcggtatagagaggttaattttgcgcgggggttgggaggggagtttggattgtcggtttcgtaagtattttattcgttgtaagcggattcgggtttaggttgatttaggtttcgcgtacgcgtatttttcgtattttttcgttttcgttttcggttagaggttatttttgtgcgtttgttcggacgttggtattcgttttcgttttttgtggtaggtggggtttgtgagtggagtttcggagcgatgaggttatttttgggggcgaagcgtgcgtgttttcgtttcggcgtttttgttttaatgagataagagttagatttcggcgatttacgttttagttttaacggttgcggcgcggttttggttcgggcgtacgcgtatattgatacgcgtatacgtacgtacgcgatcggggcggtggttggcggttacggacgcgtaggattgggggacgggcgggtacggttatgggcgaggcggaggcgttttttttcgaaatgatttggagtagtacgacgagtagtggttattgtagttaagaggattcggattcggagttcgagtagtattttatcgcgcgaatttcgttagttcgtaggtcgcgtcgggattaggtgggagttagggggtgtcggcgggcgggaggggaagcggtcgttggagtttcgtttttttcggttcgttgtcgcgttttgggtcggtgggtagttttatttttttggttacgtggtttttcgcgggttttggtcggggatttgttcgcggaatcgtgcgtaagatttcgattttatcgtttagatgttgggtgtcggggtttttttggtttttgttatagataggttgaatacggaaaaagtagttgtatggtttgtggtagatttgagtcgggtattatttagttatgattaaagtcgatcgagtagtttggattagtatttcgattttcgcgttcgaatgtttttgttttttttttggggagattaggggaggatgtggagagggaagagttttcgttaggaattgagaagtatgtttaggaaaatttgagaggtagagagagattttgtttttttatttgtatttttgtatggagttagttgagtttttattttttttttgttttggtttgttattagttgttggaatgtggaagattttgttttttttttttagggtggatttggagaaagatttgggaatagataggaaagaagttttgttttggattataagtatttaggagtattttatttataggaagggggaaagttagattataaaatgtttaaagaggtggaaaaagagatttaggttattaatttaggattgtaaggtgtttcggaattttttaggtatttttattatcggagaattgtgtgttagatgttattggtgtgattattaggtttagagaattaggtttaggtattaggaaaaagaaatagggattgtgaagtttagtatgtttggtagaaatggggcggaaatttttatttaagtaaagaaagtggagttgtgagtgatgttttagataaaattttataaaattttttataaaatgggtggtgtttagtacgttaaaattttagtttagagtttgggtgtaagggttgagttgagtgtagatttttgggtttgtttttatgttagttagttttgagttattttttattgtggaaaggtgggaaaattataagatattaattaattgaaaaggagggttagttacggaggtgtatatttgtaattttagttatttgggagggtgaggtagaaggattatttgaatttgggaggtagaggttgtagtgagttaagatcgtgttattgtattttagtttgagtgatagagtgagattttgttttaaaaatagaaaaggaagttaagtacggtggtttatatttttaatgttaatgttttgggaggttaaggtaggtggattatttgtaattaggaattcgaggttagtttggttaatatggtgaaattttatttttattaaatatataaaaattagtcgggtatggtggtgtgtgattgtagttttagttatttgggagattgaattattttaatcgggaggtaaaggttgtagtgagttaagatcgtgttattgtattttaatttgggtgatagggtgaggttttgttttaaaaaaaagaaagaaggttgggtttggtgatttatgtttgtaattttagtattttgggaggttaaggtaggtagattatttgaggttaagagttcgagatttgttaggttaatatagtaaaatttcgtttgtattgaaaatataaaaaaattatttggttatggtggtgtgtgtttgtaattttagttattggggagg

SEQ ID NO: 1174 - DNA, 12501 bp, Artificial Sequence
  chemically treated genomic DNA (Homo sapiens)
tttttttagtagttgggattataggtatatattattatggttagataatttttttgtatttttagtatagatggggttttgttatgttggtttggtaggttttgaatttttggttttaagtgatttgtttgttttggttttttaaaatgttgagattataggtatgagttattaagtttagtttttttttttttttttgagatagagttttattttgttatttaggttggagtgtagtggtatgattttggtttattgtaatttttgttttttggttgaagtgatttagttttttaagtagttgggattatagttatatattattatgtttggttaatttttgtatgtttagtagagatagggttttattatgttggttaggttgattttgaatttttgattgtaaatgatttatttgttttggttttttaaagtattggtattagaggtgtgagttattgtatttggtttttttttttatttttgagatagagttttattttgttatttaggttggagtgtagtggtatgattttggtttattgtaatttttgttttttaggtttaagtgatttttttgttttatttttttaagtagttgggattataggtgtgtatttttgtggttagtttttttttttaattggttagtgttttgtggtttttttatttttttatagtggaaaatggtttaggattgattgatatgaagataagtttaggggtttatatttaatttaatttttgtatttaagttttgggttaagattttggtgtgttgagtattatttattttgtaaggaattttgtaaaattttatttgaagtattatttataattttattttttttatttaaataaggatttttgttttatttttgttaggtatattgagttttatagtttttgttttttttttttggtgtttaggtttggttttttgagtttggtggttatattaatggtatttggtatatagttttttgataatggggatatttaggaggttttgagatattttatagttttgggttagtaatttggatttttttttttatttttttaggtattttataatttagttttttttttttttgtgggtaaagtgtttttgaatgtttatggtttaaaataagattttttttttatttatttttaaatttttttttagatttattttagaggaagggaatagaattttttatattttagtagttggtgataggttagaatagggaagaggtgagggtttagttggttttatataggagtgtagatggaggagtaggatttttttttgttttttaagtttttttaaatatattttttaatttttggtgaggatttttttttttttatatttttttttagtttttttaaggagggagtaggagtatttgaatgtggaaattgaggtgttagtttaaattgtttggttggttttagttatagttggataatgtttggtttaggtttattataagttatatagttgttttttttgtgtttaatttgtttgtgatagaaattaagggggttttggtatttagtatttaggtggtggaattggggttttatgtatggttttgtgggtaggtttttggttaggatttgtggggagttatgtagttaggagggtggggttgtttattgatttaggatgtggtaatggattggggagggtggagttttagtgattgtttttttttttgtttgttggtattttttggtttttatttggttttggtgtggtttgtgagttagtgaggtttgtgtggtgaagtattgtttgagttttgagtttgagtttttttggttgtagtagttattgtttgttgtgttgttttaggttattttgaaagaaggtgtttttgttttgtttatagttgtatttgtttgttttttagttttgtgtgtttgtagttgttaattattgttttggttgtgtgtgtgtgtgtatgtgtgttagtgtgtgtgtgtgtttgggttagagttgtgttgtaattgttaagattgaaatgtagattgttgggatttagtttttgttttattggggtaggaatgttggggtggggatatgtatgttttgtttttaggaatgattttattgttttggagttttatttatagattttatttattatagggaatgggggtgggtgttagtgtttgggtaagtgtataagagtggtttttggttggaggtgagggtgggaaggtgtgggaagtgtgtgtgtgtggagtttgggttagtttgggtttgggtttgtttgtagtgggtggagtatttgtggagttggtaatttaggttttttttttagtttttgtgtagaattagtttttttgtgttgttgggaaattggtaattagaatgttttttgtgtgtggtatttaggtagtttttgagaatgtttgtattgtggtttgtttatttttgttttttttatatgtttttggttttgtgtttattatgtttgtgttttgttttattgtgggtttttagtttaggttttggggtttgtaatagtttaggtagatgagtgtgtggtagtggtagtggtaggtgaatttgtaatttgtagagaggtttggtggtgaggtggaggagttttaggttggggaaatgttttggagattgaagggaagttttagggagagggttgttgtttgttaggttttgtaggtttgatttattttagtgggttattttatattgttatgtggattttaatgttggttatttgggtgtttggaaattggttggaaggttataggtagagaggtttgtttaatagttggatttttattgtttagtatagaattttttttttttttattggtaattaaaaaaataataataaaaaattgtgttttgtttttgttatttaggttggagtgtaatggtgtgattttggtttattgtaatttttgttttttgggtttaagtgatttttttgttttagttttttgagtatttaggattataggtgtttgttattatgtttagttaatttttgtatttttagtagagatggggttttattatgttagttaggttggttttaaatttttgattttaggtgatttatttgttttggttttttaaagtgttgggattataggtttgagttattgtatttggttttttattgggaatgtatatggaatatatttgtttatttatttgaaggaaaaattaaatatttttaatttatgtttgttttgtggttgttatttgtttttattttttttagattaagatattggtttttatatattttaattttttgtttttatttttttttttatttattttagttaggtttgtttttttttttaggaaattgtttgggatagggtttttagtgatttgtgtattattaaatggaatttagtgttttattttttatttttatttttttagtattatttgaagtttgttttttttgatttttaggggttatatttttttagttttttttttattttttgtagtttttgtttagtttttttgtagattttgatttaatttttatattttatgatgaagtttgggtttagttttgattattggtttggtttgtttatatttatttgttttagatttatggttgaaatattgatttaaatttttagattagattttttgtgttagtatttttattaggatgtttaaaagatgttttaagtgaatatggttaaaatttaatttttttttttttagttttattgttatatttgtttagttttttttttgtagtaaaaatggttattaggtttttagttattggagataaaagtttaaatttatttttgattttttttttgtttttatttttgataaatatgtttaaattattttgttttttatttttatggttattttatttttttttgagaatgttgtaatgttttagttttgttttttttttttttttttttttttttgagatagagttttattttgttgttaaggttggagggtagtggtatgattttggtttattgtaatttttgttttttgtgtttaagtaatttttttattttagttttttgagtagttgggattataggtatttgttattatgtttggtttatttttttttattttttagtagatatgaggttttattatgttggttaggttggttttgaatttttgattttaggtgatttatttgtttttgttttttgaagtgttgggattataggtatgagttattgtgtttggttttttgtttattttttgtattttgttataattttgtgttttttttagttgaatttgtgatgtttttttgtattggatgagagggtttttatgtatatatagatttgggatattatttatttataagtttttaaataggttagagtagtgatgtttaatttagattttatgttataataatttggggagtttttaaaatttattgatgtttagggtttatttttagtagttgatttaataggtttgtggtgggatttaggttagtggggaggattgtaaaagtatttttggtgattttagttggtgtttatttaggggagagtaatttttgtttgttggtgatttttaggggtgtagaaggattgttgggtgtgtggttgtgtgtatattttagtatttgatttattgggttagaaaagggtgtttgttaaataaagatttaataaaatttttgtttgtagggggtttattaaaggttttaaatttttttaggtttttttttataggtggtaatttttttttattttaaaggttttggagggggttatgagtgtttgagaagaggtaagtttgggaagatggattttgaggatagtaggtataaatttttttttaagaagggttaaggtattttaaagataagaaatttaaaattagtgtatttttatatataagtagttatttttgtttatttgtggtttagatatgagtggagtgtgataagggataaattatttttgtgtattttttagtgatggggtgaaagtaatggatttagtttttgggagttgtttttgttgattttttttgttgtgatttgatttgtggtgattgtgttgttttttggttgttttttttgtttttgtaggtgtgtggggttattatttatgtgtgtattgtaggtttttgtgtatgatgttttagatgaagttgttatagaggttgtattatgtgtgtgtggtgggttttgtgggttggaagtggtggttatggttagggattagttgttgtgtggggttgtatgtggtgttttgtgtgatgtgtagtgtgttggtatgttttagttgggtgtggttttttttagtgtgtttagtgggtgttagtttttgtagtttaatgagtttaggtttttttgatatggtttggttgggtttgtgttttgttggttttgggtgttagtaagtgtgggttgggtggggttatagggtgggttttgattttagtgttttttttaggatttagattgggtggtgggaaggagttgaggagagttgtgtaatggaaatttgggtgtagggattgtggggtttgaaggtggggttgggtgtgtttttgtagagttttttttgttttgttttttttttttttttttgttttttttttatattttattttggatggttataatgatggtgattgtaaagtattatgtggagatatttgtgtttttggaggttagttttattgtgttagaggaagagggtttttatatttggttttggtttttttggtttggtttgttgaagtaatatatttggtttatttattgggtggggtaggaagttttgagtttttatttggggtgaggaggagggagattggttagtagttttattgtttgttttgttttttattgtggagattggggttttggtagaggttggattgtgattttgaggtttaggggtgtattttgggtggatttttttggtatgggtggttggtttttagtaattgtagtttttatttggttttgttattttgggttgttaggatataagtttttttatgttttttttagtgtttgatttggtattttttgtaggtaggtgggtattgaggatggtaatgtatgtgggggatgtgggagtagggtttagaggtttaaggttttaggatatttttatttgtagtaatattatttattttggtattgtgagtagtgtttagaagtttttgtattgtagtaagtatagtggggttgttttggagttattgtttttagtatatttagtttgtaggttttagtttatttgggggaaagttaggaaggtttgattggttttggaaggtgggggtattttatttatatttatgttttttgtattttttttattttttttgttatttttataggttttatttttgtgtttgtagttgtaggttttgttttgaggggttgaatatatgttggagttggtgtttggtaattgtttgttatttgtttttgtttttttgttttagttgtttttagatttttgggatttaggagagagaagtggagagtggtaggaaggtgttggtaaagtgggatagtggttttgagtagttaattttttagtgtttatttgttttaatattaggttttttttaggaggttgggttttagttagggttagatgggttaggaaattttgtaagtgggttaggttgggtagttggtttagtagtgtgtttgtgaggaaggtttgaagttgtaagggtgtttagtggaggttagtgtgatgtaggtgttggttagggggttaaggaaaaggaaggggttgggttgggttgagaatgtttgtgggggtttatgttttattagttggtgtgttatttgaggtttaaggattgaaaagagtattggggttgaggtgggtgggtaaagataaatagtagggatgtagttggggtaggatggggagggtggtattggggttgtgggggttggtgtggagggagtttgattttgagtagttgttttttggtaaaatttgtgaggtagtagtgtgtttgagttttagggtttagtagtaggttgtatagggtgatttatatttgtttgtttaatttgtttagtttttgttgttttgagggggttatagtatgttaatggttgtttttgaattgttgtagtttgtttggggagaggaattagtatattgggtgtagatgttgaattttttttaagtgagttagttgtgggggttgggagattgattattgtttgggaatgggagaatttgggttgtaggatttgtttaggttatagggttgttgattttagagtagggtgagttttagtagtggatatatgggtttggtttgttgtagagtttaggtttaggttaattttggttgaggtattttggtatttttagtgggtttggggatagggtttgtttttgtgtgtgtaagttgtttttttttattaaaaagatattttgaagtagtagtttggggtttaggttggtgggggaggattttattttttttttgttggttttagggattatgttttagtagttttattaggaggtagggtaggttgtgtgtgttaagtatatggtttaaggtgttgagagagaggttaggggtagggatgttgtgaaggaggtgagtagaggtaggttataggtttggttttttagttttttatagtaggtttaggtttagttggattgtttatttgtttatatagtttgtgatgtagtgtagtattgagagggtttttagtgtaattttaaattttattagttttgtttgtttttgtagtttttgggaggttatatagtgtttatgttgggttatttttatttgtgtaggttttggggaatttagatttaggtttttataattttaggtaattttaatttatttgtatggggttgttgttttgggattttttttttttaggggggttattatagttattttgggttattagtagggttagtttgtggtggtaatagtttattaagtttaagatagtgttttttgttgatttatatattttttgggaaaaggaggagggaaattttttgtgtttgatgttttttttatatagatataatttttttttttgttaggttttgatttggaattgtggtttatgggtagagatagttttttattttgtggaagaatattgtttttaagaggttgatgatggaggttttgtggtgtatttgttagataaagagaaggatagggtttgaggaagggataggggttattagtttttttttttggtttagagttttttgaaggagtgagaagaggtatgaattaggggtttagtttattattatgtagatggggaaggtgttttggggtttgaagttttttattttgtagaatatagggaatattttttgtttttatatttttattgtgattagtttttttattagtgttgggatttttgaagggtagggtaaaggatagggatgagatgggtttatttttgtttggtaatttttttatttttggtttagtttaattttgatatttttaaatattgttgggtttttaaattattttagatttatgagtattttttttgattttttttttgtattttggatttttattattagttgtttttaatatttttgtggatgttttttatgtttatgtgattggtttttgtttagtttttagattgttttgttttgtttgtatttgtatttttattttttgtttgtttatttaggtattttttttaagttagtttttttttttatgttttttttttagtttttgtttgtggttttttaaagtttttgtgtgttttggttttatttttatttaggattttttatagtgttttgtttttattttattttttagtatgagttttattttttttttgtaaaggattttttttttttttttttttttttttgagatggagttttatttttgttatttaggttggagtgtagtggtatgattttggttttttgtaatttttgttttttaggtttaagtgatttttttgttttagttttttgagtagttgggattataggtgtgtattattatgttttgtaaatttttgtatttttagtagaggtggggttttattatgttggttaggttggttttgaatttttgattttagatgatttatttgttttggttttttaaaatgttgggataataggtatgagttattatgtttggtttttttttttttttttttggttaattgatattttaggttatttgttggtgatattttttggtttatgttttagttaggtatttttttggtttttaattttttttttttatgttgggaaggttgtttttttttatgttgaagttttatttttagttaggttatttttttttttttttgttttttttaatttttttttattttttttttattattagttttatagttaatttatagatgtttttagtatttgggttttttttttgaagtttaagttgttttaggatttatagttttttttttaattaatttatgttttgtatttagtttggtgtgttagagttttgtttaatagggatataaaatgaaatatgtaatatatttttttttgttttttagggagaataggtgtattaggttagaggggaagggtatataggggattttggaggggtagagtaggtgaggtatgggggaaggtaggaattttgtttgtgattttggggtatttttttatgggtgattagtagtttttgaatgggtttgttttggttgattgtggtattgaggatggtttgtatgtttagtttttttaggtttttatgttgttggttttatttgttttagagggtaagtgtatgtgtgtttatgtgtgtgtattaggagtggggatgggggttggattttattgaagtttaatttgattttgaggggatatagggggtttaggagtagtaatatttttgttttggaatgttttgtttttttatttgggagtttttttatattgggtagttttttttttgagttaggttttagttttttgatttaaggataatgattttgggattttgtttgatttgggtgttttattttttggagtttattttgtgtagtgggaagttgtgtagattttgtattagtattttagtttttttgggtagtagtagttttaggttttttatattgaggttggggtttggtggattttgggtagtagttggggtggggatgttgttatatttggggatgatggattttgatggtgttaaagtttgggataggatagttgtgggatggttggggagtgttagtttttgtagttatggaaatgggttagttgtgtttgtgtagtgtggtttgggttttgtttttggaggtggtttgtgtttaaatttgggtgggtttttagtttgttttgtttatgtgattgttaattgttatagtatttggatttttagtgtttttttgggttgtggtttatgagttttttttgagttttagatttttgtggtttggattttgtttttagatgttaagtttgtttgtatagggatgggggtaattttgattttaatagttttttttgtggttgtggtattttgatttatttgttgtttttttttttttttatggttttttggtttttttattttttgtgttttggttttattagttggtttttgaaatattgttagggtgtatgatttttttttattttttttatgtttagattgttattatttgttatgggtgaattgtggtagttttttttgtagatttatttttatgtttgatttttatggatagtttggagttttaaaagtgtatattaggttgggtgtggtggttgatatttgtaattttagtattttgggaggttgaggtaggtggattatttgaggttaggagtttgagattagtttgggtaatatggtgaaattttgtttttattaaaagtataaaaattagataggtgtggtagtatatatttgtagttttagttatatgggagattgaggtaggagaattgtttgagtataggaggtggagtttgtagtgaggtaagattgtattattgtattttagtttggataataaagggagattgttttaaaaaaaaaaaaaaagtatatagatattatttttttgtgtgagaggggttttgtggttatttttggtttttaaaatgttaggtgggatgttgtttattagtagttttgtaagatttattttttgtttttttttgtattttgggatttggattttttttttttttttttgtttttttgaattttttttatatattttaaagaggtttttgttttagagttttgtattttgtttggaatattttttttttagggtttagtttatattttagtatggttttttttggttatttaatttagagtagtttttgtttttaatttaatttatttttgattatatttttttttgaaattgagttttttgttatttaggttggagtgtagtggtatgattttggtttattgtaatttttgttttttaggtttaagtgatttttttgttttagttttttgagtagttgggattataggtgtgtattattatatttggttaattttttgtatttttttttagtggagatggggttttattatgttggttaggttgtttttgaatatttgattttaggtgatttgtttgttttagttttttaaagtgttgggattataggtatgagttattgtgtttggttatatttgtttttttttaggtttatttattattattattattattgagatggggttttgttttgttatttaggttggggtgtagtgatgggattatagttaaatgtagtttttaatttgtggttttaaatgatttttttattttagttttttgagtagttggggttataggtgagttattgtattaggatgatttttttttttttttttttttttttttgtaattaattggtatttttatttgttgattgttggttttgtttattagatggtgatttagtttatggtttgtggttattttatttattgttgggttttttatggttggtttagaaatagtatttaataaaggttgtttgaaatggatgtttttatttatagaattaagagttaatttttagatagtatgataagttttttagtaggagggattatttatagtaatgtgtttatttagttattattagttttatttttagtagatgatgatgttggggttatttttaagttgtttatttagtttatggtagtttatgtttgggtggggtggtggaggagaggttagtggttttggtttggttattttgttttgaatttattttgattgtttgtttgtttttatttgttttgtagtagattttgttatagttgtggtagtttgtataaagttgggtagggtggttttgttttttttgagttatttgtataggatatttttgtagttgtttgatgaggttttttataagtttgaattggattagttttttagggtgaggattagaggatggggtgatgttttg

SEQ ID NO: 1175 - DNA, 12501 bp, Artificial Sequence
  chemically treated genomic DNA (Homo sapiens)
tagggtgttattttgttttttgatttttattttaggaagttgatttagtttgggtttatgaagaattttattaggtgattatagaagtattttgtgtgggtgatttgggaagagtagagttattttgtttggttttatataggttgttatagttatgatgagatttgttgtaagataggtggaggtaggtgggtagttagggtgggtttagggtagggtggttaggttaaggttattgattttttttttattattttatttaggtatgagttattatgagttggatgagtggtttgaaaatgattttaatattattatttgttggaagtgaggttggtagtgattggatggatatattgttgtgggtagttttttttattaggaggtttgttatattgtttagaggttgatttttagttttgtaaataaagatatttattttaaatagtttttattgagtgttgtttttgggttagttgtgggagatttagtagtgaatgaaatagttatgagttgtgggttagattgttatttggtgggtaggattgataattgataaataaaagtgttggttaattataaaaaaaaaaaaaaaaaaaaaaaaaaattgttttgatgtggtgatttatttgtagttttagttatttaggaggttgaagtggggggattatttgaggttatgagttggaggttatatttagttgtgattttattattgtattttagtttgggtgatagagtaagattttattttaataataataataataataaataaatttagaaagaagtagatgtagttaggtgtggtggtttatgtttataattttagtattttgggaggttgaagtgggtagattatttgaggttagatgtttaaaaatagtttggttaatatagtgaaattttatttttattaaaaaaaaatataaaaaattagttaggtgtggtggtgtatatttgtaattttagttatttaggaagttgaggtaggagaattatttgaatttgggaggtagaggttgtagtgagttaagattatgttattgtattttagtttaggtgataggagatttaattttaaaaaaagatgtgattaagagtgagttgggttggaggtagggattgttttggattaaatggttaagaaaggttatgttgaggtgtaaattgagttttgaaggaaaagtattttaggtaaagtgtaaaattttgaggtaaaaatttttttggaatgtatgagggaggtttagggaagtaaggaggagaggaaagaatttaagttttgaggtataggagaggataagaagtagattttgtagagttgttagtaagtggtattttatttaatattttgagggttagaagtagttatagagttttttttatgtaagggagtaatgtttatatgttttttttttttttttgagatggtttttttttgttgtttaggttggagtgtggtggtgtaattttgttttattgtaaattttattttttgtgtttaagtgatttttttgttttagttttttatgtagttgggattataggtgtgtgttattatatttgtttaatttttgtatttttagtagagatagggttttattatgttgtttaggttggttttaaatttttgattttaagtgatttgtttgttttggttttttaaagtgttgagattataggtgttagttattgtgtttggtttgatatatatttttaaggttttgggttgtttatgaggattaagtgtggaagtaggtttatagaaaaggttgttgtagtttatttatgataggtgatgatagtttggatatagggaggatggagagaagttgtgtgttttggtagtattttaggagttaattagtggagttgggatgtgagaaatagaggaattaagaagttataaggaggaggaagagtagtgggtaggttaagatgttatagttgtaggaggggttgttggggttggggttatttttatttttgtgtaggtggatttggtgtttgaggatagagtttagattataaggatttggagtttaggagagatttgtgggttatagtttgagaaagtgttgggaatttaaatattatggtgattggtagttgtgtaggtgaggtgggttagagatttgtttggatttaggtgtgagttatttttaggggtggggtttaggttgtattgtgtaggtgtggttaatttgtttttatggttgtgagaattgatgttttttaattgttttgtaattgttttgttttagattttggtattgttggggtttgttgtttttgaatgtgatagtatttttattttggttgttgtttaggatttgttggattttggttttgatatgggagatttggaattgttgttgtttggggaagttgaagtgttggtgtggggtttgtgtagttttttgttatgtgagatgggttttgaagggtgaggtatttgggttaggtggagttttggagttattgtttttgagttggggagttggggtttgatttgggggaggggttgtttagtgtggaggggtttttaaatgggggagtagagtgttttgagataggagtattattgtttttgagttttttgtgtttttttaggattaggttaggttttagtaggatttagtttttatttttatttttaatgtatatatgtggatgtatatgtatttattttttgaggtaggtggaattagtagtatgagaatttggagaagttgaatatgtaagttatttttgatgttatagttagttagggtgagtttatttaggagttgttggttatttatgggaaggtattttgaggttataggtagggtttttgtttttttttatattttatttattttatttttttggagttttttgtgtgttttttttttttggtttggtatatttgttttttttgaaggataaagaggaatgtgttatatgttttattttgtatttttattggataggattttggtatattaggttgggtgtagggtatgagttgattagggagaaagttgtaggttttagaatagtttaggttttaaggggaaggtttaaatgttaaaggtatttgtgaattgattgtaaggttggtggtggggaaggggtggggaggggttggggagggtgggagggaggggagataatttaattggaggtggaattttggtatggaaggaagtagtttttttaatatgaaagggggaagttagaaattagggagatgtttggttggaatatggattagggagtgttattagtagatgatttgagatattaattgattaaaaaaaaaaaaaaaaaagttgggtatggtagtttatgtttgttattttagtattttgggaggttaagatgggtggattatttgaggttaggagtttaaggttagtttggttaatatggtgaaattttatttttattaaaaatataaaaatttgtagagtatggtggtgtatatttgtaattttagttatttgggaggttgaggtaggagaattgtttgaatttgggaggtagaggttatagagagttaagattatgttattgtattttagtttgggtgataagagtgaaattttgttttaaaaaaaaaaaaaaaaaaaagaaaggttttttgtaaaagaaagatggaatttatattaggggataggataggaatagggtattgtgaagggttttgagtaggagtgaggttaaggtatataagagttttggaggattatagatagggattagagggagggtatgaggagaagggttggtttgaaagggatgtttgaatgggtgggtagaggataagggtgtaggtgtaggtagggtaaggtagtttgggaattgggtaggagttagttatataagtatgagggatatttatagaggtgttgggagtagttggtaatgaaggtttaaggtgtaagagagaagttaggaaggatatttatgggtttggaatagtttaggggtttagtagtgtttggggatattagggttgagttgagttggggatgggagggttgttaggtaaaggtaggtttattttatttttgttttttattttattttttaaaggttttaatattggtggaggagttgattgtagtggagatgtggaagtagaaggtgttttttgtgttttgtagggtggaggattttaagttttagaatattttttttatttatatggtggtgagttgggtttttggtttatatttttttttatttttttagagggttttggattggggaggagagttggtagtttttattttttttttaggttttgtttttttttttatttgataggtgtattatgaggtttttattattaattttttggagatagtgtttttttataaggtgagggattatttttgtttatgggttatagttttgggttagggtttggtaggaagggagattgtgtttgtgtggggaaggtattagatatagaaagtttttttttttttttttttaggaggtgtgtgagttagtagaagatattgttttggatttggtagattattgttattgtaaattgattttgttggtggtttagagtggttgtggtggtttttttgagggggagggattttaggatagtaattttatgtaggtgggttgaggttatttagggttgtgaaagtttaggtttgggttttttaaggtttgtgtaggtgagggtggtttagtgtgaatattgtgtgattttttaggagttgtagaagtaggtagagttgatggaatttgagattgtattgaaggtttttttagtattatgttatattatagattgtgtggataggtgagtagtttgattgggtttgggtttattgtggagggttggaagattgggtttgtagtttgtttttatttattttttttataatgtttttgtttttagttttttttttagtattttgagttgtatgtttagtatatataatttgttttgttttttggtggaattgttggagtatagtttttggagttggtgggaaggaggtagggtttttttttattagtttaagttttaggttattgttttagggtatttttttgatagaggggggtagtttgtatatatgaagataaattttgtttttaagtttattgaggatattaggatgttttagttaaggttggtttagatttgagttttgtagtaggttaggtttatgtgtttattattgaggtttattttgttttggggttagtagttttatagtttgggtaagttttgtagtttaggtttttttatttttaggtagtggttagttttttagtttttatagttggtttatttgaagagaatttaatgtttgtatttagtgtgttggtttttttttttaggtaagttgtagtagtttgagggtagttgttggtatattgtggtttttttagagtagtaaaagttgagtaagttggatgggtaagtgtggattgttttgtataatttgttgttaagttttgaggtttaggtgtgttattgttttataagttttgttaagggatggttatttaaggttagattttttttgtattagtttttatagttttagtattgttttttttattttattttgattgtgtttttgttgtttatttttgtttatttattttaattttagtgttttttttagtttttgggttttaggtgatatattagttagtgggatatgggtttttataggtatttttagtttaatttagttttttttttttttttggttttttggttagtatttgtattatattggtttttattggatatttttgtagttttgggttttttttatagatatattgttggattagttgtttaatttggtttatttgtagagttttttggtttatttgattttaattgaaatttagttttttaagaaggatttggtgttggaataggtaggtattggaaagttagttgtttaggattattgttttattttattagtatttttttgttattttttattttttttttttagattttagaaatttgggagtggttggagtgagaaaatagaggtaagtggtaggtaattgttaagtattagttttagtatgtgtttagttttttagagtaggatttgtggttgtaggtgtgaaggtaaggtttgtggaaatggtagggagggtggaggggatgtaggaggtatggatgtgggtggggtgtttttattttttagggttagttagatttttttgatttttttttaggtgggttgagatttataggttggatgtgttagaggtagtggttttagagtggttttgttgtgtttattgtagtgtagaggtttttaagtgttgtttatgatgttagaatgagtggtattgttgtaggtgagggtattttagaattttggatttttaagttttatttttatattttttatatgtattgttatttttaatatttatttgtttgtagggagtgttaagttaagtattgggaaaagtatggaaagatttgtgttttggtagtttagggtgatagagttaaatgagggttgtagttgttgagggttgattatttatgttaagggaatttatttagaatgtatttttgaattttaagattatggtttagtttttgttggagttttagtttttgtagtggagagtagagtgggtggtaaagttgttgattgattttttttttttttattttaagtgaaggtttgagattttttgttttatttagtgggtaggttaagtgtgttgttttagtaaattggattaggagggttagggttggatgtggggattttttttttttagtatagtaaagttggtttttagaaatatgggtatttttgtgtggtgttttgtggttgttgttgttgtggttgtttggggtggggtgtgaggaggggatgaaggagggaaggaagggtaaggtggggggggttttgtgagagtgtgtttagttttgtttttgggttttatagtttttgtatttaggtttttattgtgtggttttttttagtttttttttgttgtttagtttggattttgggggaggtgttgaagttggggtttgttttgtggttttgtttggtttgtgtttgttagtgtttaaagttagtgaagtatgggtttaattgggttatgttgggggagtttgagtttattgagttgtgggagttggtatttgttgggtgtgttgggaagggttgtatttggttggagtgtgttaatgtgttgtgtattgtgtggggtattgtgtgtaattttatatggtagttggtttttggttgtggttattgtttttagtttgtggggtttgttatgtatatgtggtgtgatttttgtggtgattttatttggggtgttgtgtgtaaaggtttgtagtgtgtgtgtgagtagtggttttgtgtgtttatgagagtggaaggggtagttaaggggtagtgtagttgttgtgggttaagttgtggtagagggggttggtggggatagtttttgaggattaggtttgttatttttgttttattgttgaagagtgtgtgaaaatggtttattttttgttgtattttatttgtatttgggttatagatgagtagaggtggttgtttatatgtaaaaatatgttgattttaagttttttatttttaaaatgttttggttttttttgagaaagggtttgtgtttattgtttttggagtttatttttttaggtttgtttttttttaaatatttatgattttttttagaatttttagggtgaagggaaattattatttatgggagggagtttggaaaaatttagaatttttggtgggttttttgtaagtaggagttttgttgagtttttatttagtaaatatttttttttgatttagtgaattagatgttaaaatatgtatgtagttatatatttagtagtttttttgtatttttgggaattgttagtaagtaaaggttgtttttttttgggtagatattagttggaattattaggggtgtttttatagttttttttgttagtttggattttattgtagatttgttgaattaattgttgggagtggattttaggtattagtaaattttaaaaattttttaaattattgtaatatggagtttgggttgagtattattgttttggtttatttaggaatttgtggatggatagtgttttaggtttgtgtgtgtatggagatttttttatttggtataagaggatattataaatttagttggggggagtataaagttgtgatagaatgtaaagaatgaataaggggttgagtgtggtggtttatgtttgtaattttagtattttggaaggtggaggtgggtggattatttgaggttaggagtttaagattagtttggttaatatggtgaaattttatgtttattaaaaaataaaaaaaaatgagttaggtgtagtggtgggtgtttgtaattttagttatttgggaggttgaggtgggagaattgtttgaatataggaggtggaggttgtagtgagttgagattgtgttattgttttttagttttggtgatagagtgagattttgttttaaaaaaaaaaaaaaaaaaaaaaagaataaggttgggatattgtagtgtttttaaagagaaataaagtagttatggagataagaagtaggatgatttgggtatgtttattagaggtagagataagggagaaattaaagataagtttgggtttttgtttttagtaattgggagtttagtggttatttttgttgtaaagaggaagttgggtaagtgtagtagtgaggttgaagaaaagggaattaaattttggttatgtttatttgaaatgttttttagatattttagtgaaggtattggtatggaggatttagtttgagggtttaggttagtgttttagttgtggatttggggtagatgaatgtagatagattaggttagtgattaggattgagtttagattttattgtgagatatggaagttgagttagaatttgtaaaggagttgagtaggagttgtagggggtaggaggaaaattgggagagtgtagtttttgggagttaaagggagtaagttttaaatgatgttgagggggtgagaatggagaatggaatattggattttatttggtagtatatagattgttgaggattttgttttgggtagttttttggaggaagaggtaagtttggttggagtgggtagaggggagagtgaaggtgaaggattagagtgtatagagattagtgttttggtttgaggggagtagagataggtgataattatagggtagatgtaggttaaaggtgtttagttttttttttaagtaaatgggtagatgtattttatatatgtttttagtgaagggttgggtgtggtggtttaagtttgtagttttagtattttggaaggttgaggtgggtggattatttgagattaggagtttgagattagtttggttaatatggtgaaattttgtttttattaaaaatataaaaattagttgggtatggtggtgggtgtttgtaattttaggtatttaggaggttgaggtagaagaattgtttgaatttaggaggtggaggttgtggtgagttgaaattgtgttattgtattttagtttgggtgataaaagtaagatgtagttttttgttgttgtttttttaattgttaatgaggaaaggggaagttttgtgttaggtgatagagatttaattgttgagtaggtttttttgtttgtggttttttggttggtttttagatgtttaggtggttaatattagagtttgtgtagtagtgtgaggtaatttattgagataggttgggtttgtggagtttggtgagtagtggttttttttttggggtttttttttaatttttgggatatttttttgatttggagtttttttgttttattgttaggtttttttgtagattgtaagtttatttgttattattgttgttgtgtgtttgtttgtttggattgttgtgggttttgggatttgggttgggaatttgtggtggagtgggatatgaatgtggtgagtgtggggttgagggtgtatgggaagggtgaggatgggtaggttatagtgtaggtatttttgagggttgtttgggtgttgtgtgtaaggagtgttttaattgttgattttttggtggtatagagaggttaattttgtgtgggggttgggaggggagtttggattgttggttttgtaagtattttatttgttgtaagtggatttgggtttaggttgatttaggttttgtgtatgtgtattttttgtatttttttgtttttgtttttggttagaggttatttttgtgtgtttgtttggatgttggtatttgtttttgttttttgtggtaggtggggtttgtgagtggagttttggagtgatgaggttatttttgggggtgaagtgtgtgtgtttttgttttggtgtttttgttttaatgagataagagttagattttggtgatttatgttttagttttaatggttgtggtgtggttttggtttgggtgtatgtgtatattgatatgtgtatatgtatgtatgtgattggggtggtggttggtggttatggatgtgtaggattgggggatgggtgggtatggttatgggtgaggtggaggtgtttttttttgaaatgatttggagtagtatgatgagtagtggttattgtagttaagaggatttggatttggagtttgagtagtattttattgtgtgaattttgttagtttgtaggttgtgttgggattaggtgggagttagggggtgttggtgggtgggaggggaagtggttgttggagttttgttttttttggtttgttgttgtgttttgggttggtgggtagttttatttttttggttatgtggttttttgtgggttttggttggggatttgtttgtggaattgtgtgtaagattttgattttattgtttagatgttgggtgttggggtttttttggtttttgttatagataggttgaatatggaaaaagtagttgtatggtttgtggtagatttgagttgggtattatttagttatgattaaagttgattgagtagtttggattagtattttgatttttgtgtttgaatgtttttgttttttttttggggagattaggggaggatgtggagagggaagagtttttgttaggaattgagaagtatgtttaggaaaatttgagaggtagagagagattttgtttttttatttgtatttttgtatggagttagttgagtttttattttttttttgttttggtttgttattagttgttggaatgtggaagattttgttttttttttttagggtggatttggagaaagatttgggaatagataggaaagaagttttgttttggattataagtatttaggagtattttatttataggaagggggaaagttagattataaaatgtttaaagaggtggaaaaagagatttaggttattaatttaggattgtaaggtgttttggaattttttaggtatttttattattggagaattgtgtgttagatgttattggtgtgattattaggtttagagaattaggtttaggtattaggaaaaagaaatagggattgtgaagtttagtatgtttggtagaaatggggtggaaatttttatttaagtaaagaaagtggagttgtgagtgatgttttagataaaattttataaaattttttataaaatgggtggtgtttagtatgttaaaattttagtttagagtttgggtgtaagggttgagttgagtgtagatttttgggtttgtttttatgttagttagttttgagttattttttattgtggaaaggtgggaaaattataagatattaattaattgaaaaggagggttagttatggaggtgtatatttgtaattttagttatttgggagggtgaggtagaaggattatttgaatttgggaggtagaggttgtagtgagttaagattgtgttattgtattttagtttgagtgatagagtgagattttgttttaaaaatagaaaaggaagttaagtatggtggtttatatttttaatgttaatgttttgggaggttaaggtaggtggattatttgtaattaggaatttgaggttagtttggttaatatggtgaaattttatttttattaaatatataaaaattagttgggtatggtggtgtgtgattgtagttttagttatttgggagattgaattattttaattgggaggtaaaggttgtagtgagttaagattgtgttattgtattttaatttgggtgatagggtgaggttttgttttaaaaaaaagaaagaaggttgggtttggtgatttatgtttgtaattttagtattttgggaggttaaggtaggtagattatttgaggttaagagtttgagatttgttaggttaatatagtaaaattttgtttgtattgaaaatataaaaaaattatttggttatggtggtgtgtgtttgtaattttagttattggggagg

SEQ ID NO: 1176 - DNA, 24 bp, Artificial Sequence
  chemically treated genomic DNA (Homo sapiens)
cccgtacttcgctaactttaaacg

SEQ ID NO: 1177 - DNA, 18 bp, Artificial Sequence
  chemically treated genomic DNA (Homo sapiens)
gcgttgaagtcggggttc

SEQ ID NO: 1178 - DNA, 24 bp, Artificial Sequence
  chemically treated genomic DNA (Homo sapiens)
acaaacgcgaaccgaacgaaacca

SEQ ID NO: 1179 - DNA, 21 bp, Artificial Sequence
  chemically treated genomic DNA (Homo sapiens)
tccgtaaataacgaatcaccg

SEQ ID NO: 1180 - DNA, 27 bp, Artificial Sequence
  chemically treated genomic DNA (Homo sapiens)
ttttaatgttcgtatcgtaattatcgt

SEQ ID NO: 1181 - DNA, 20 bp, Artificial Sequence
  chemically treated genomic DNA (Homo sapiens)
acgcacgcacacacacccga

We claim:

1. A method for analyzing methylation status in a prostate sample in a subject, comprising:
   a) obtaining from the subject a biological sample comprising prostate genomic DNA;
   b) contacting Histone H4 genomic DNA as set forth in SEQ ID NO: 36, or a nucleic acid sequence 100% complementary thereto, in the biological sample with bisulfite to provide pre-treated DNA sequences selected from the group consisting of SEQ ID NO: 130, 131, 248, and 249 or nucleic acid sequences 100% complementary thereto; and
   c) determining the CpG methylation status of at least one CpG dinucleotide within: SEQ ID NO: 36 or a nucleic acid sequence 100% complementary thereto; or the pre-treated DNA or nucleic acid sequences 100% complementary thereto.

2. The method of claim 1, wherein distinguishing between methylated and non-methylated CpG dinucleotide sequences comprises converting unmethylated cytosine bases within the target sequence to uracil or to another base that is detectably dissimilar to cytosine in terms of hybridization properties.

3. The method of claim 1, wherein distinguishing between methylated and non-methylated CpG dinucleotide sequences comprises methylation state-dependent conversion or non-conversion of at least one CpG dinucleotide sequence to the corresponding converted or non-converted dinucleotide sequence within the pre-treated sequence selected from the group consisting of SEQ ID NO: 130, 131, 248, and 249.

4. The method of claim 1, wherein the biological sample is selected from the group consisting of cell lines, histological slides, biopsies, paraffin-embedded tissue, bodily fluids, ejaculate, urine, blood, and combinations thereof.

5. A method for detecting, or detecting and distinguishing between or among prostate cell proliferative disorders in a subject, comprising:
   a. obtaining, from the subject, a biological sample having prostate genomic DNA;
   b. isolating the genomic DNA;
   c. treating the genomic DNA of b) with at least one reagent to convert cytosine bases that are unmethylated in the 5-position thereof to uracil or to another base that has detectably dissimilar hybridization properties compared to cytosine to provide pre-treated DNA sequences, wherein the pre-treated DNA sequences are derived from Histone H4 genomic DNA according to SEQ ID NO: 36 and are selected from the group consisting of SEQ ID NO: 130, 131, 248, and 249; and
   d. contacting the pre-treated genomic DNA with an amplification enzyme and at least two primers, wherein each primer comprises a single stranded nucleic acid at least 9 nucleotides in length that hybridizes under stringent conditions to a sequence selected from the group consisting of SEQ ID NO: 130, 131, 248, 249 and nucleic acid sequences 100% complementary thereto, wherein the pre-treated genomic DNA is either amplified to produce at least one amplificate, or is not amplified, wherein the amplification is methylation specific for at least one CpG dinucleotide of a sequence within Histone H4 genomic DNA as set forth in SEQ ID NO:36; and
   e. determining, based on a presence or absence of an amplificate, a methylation state of at least one CpG dinucleotide of a sequence within SEQ ID NO: 36, or an average, or a value reflecting an average methylation state of a plurality of CpG dinucleotides of a sequence within SEQ ID NO: 36, wherein a higher degree of CpG methylation in the sample, compared to that of a normal control, indicates a presence or distinguishes between prostate cell proliferative disorders, thereby detecting and/or distinguishing between or among prostate cell proliferative disorders in the subject.

6. The method of claim 5, wherein treating the at least one reagent is selected from the group consisting of bisulfite, hydrogen sulfite, disulfite, and combinations thereof.

7. The method of claim 5, wherein contacting or amplifying in d) comprises use of at least one method selected from the group consisting of: use of a heat-resistant DNA polymerase as the amplification enzyme; use of a polymerase lacking 5'-3' exonuclease activity; use of a polymerase chain reaction (PCR); generation of a amplificate nucleic acid molecule carrying a detectable labels; and combinations thereof.

8. The method of claim 7, wherein the detectable amplificate label is selected from the label group consisting of: fluorescent labels; radionuclides or radiolabels; amplificate mass labels detectable in a mass spectrometer; detachable amplificate fragment mass labels detectable in a mass spectrometer; amplificate, and detachable amplificate fragment mass labels having a single-positive or single-negative net charge detectable in a mass spectrometer; and combinations thereof.

9. The method of claim 5, wherein the biological sample obtained from the subject is selected from the group consisting of cell lines, histological slides, biopsies, paraffin-embedded tissue, bodily fluids, ejaculate, urine, blood, and combinations thereof.

10. The method of claim 5, wherein contacting or amplifying in d), comprises use of methylation-specific primers.

11. The method of claim 5 comprising in d) using primer oligonucleotides comprising one or more CpG; TpG or CpA dinucleotides; and further comprising in e) the use of at least one method selected from the group consisting of: hybridizing in at least one nucleic acid molecule or peptide nucleic acid molecule comprising a contiguous sequence at least 9 nucleotides in length that is 100% complementary to, or hybridizes under stringent conditions to a sequence selected from the group consisting of SEQ ID NO: 130, 131, 248, 249, and nucleic acid sequences 100% complementary thereto; hybridizing at least one nucleic acid molecule that is bound to a solid phase and comprises a contiguous sequence at least 9 nucleotides in length that is 100% complementary to, or hybridizes under stringent conditions to a sequence selected from the group consisting of SEQ ID NO: 130, 131, 248, 249, and nucleic acid sequences 100% complementary thereto; hybridizing at least one nucleic acid molecule comprising a contiguous sequence at least 9 nucleotides in length that is 100% complementary to, or hybridizes under stringent conditions to a sequence selected from the group consisting of SEQ ID NO: 130, 131, 248, 249, and nucleic acid sequences 100% complementary thereto, and extending at least one such hybridized nucleic acid molecule by at least one nucleotide base; and sequencing in e) of the amplificate.

12. The method of claim 5 comprising in d) use of at least one nucleic acid molecule or peptide nucleic acid molecule comprising in each case a contiguous sequence at least 9 nucleotides in length that is 100% complementary to, or hybridizes under stringent conditions to a sequence selected from the group consisting of SEQ ID NO: 130, 131, 248, 249, and nucleic acid sequences 100% complementary thereto, wherein said nucleic acid molecule or peptide nucleic acid molecule suppresses amplification of the nucleic acid to which it is hybridized; and further comprising in e) the use of at least one method selected from the group consisting of: hybridizing in at least one nucleic acid molecule or peptide nucleic acid molecule comprising a contiguous sequence at least 9 nucleotides in length that is 100% complementary to, or hybridizes under stringent conditions to a sequence selected from the group consisting of SEQ ID NO: 130, 131, 248, 249, and nucleic acid sequences 100% complementary thereto; hybridizing at least one nucleic acid molecule that is bound to a solid phase and comprises a contiguous sequence at least 9 nucleotides in length that is 100% complementary to, or hybridizes under stringent conditions to a sequence selected from the group consisting of SEQ ID NO: 130, 131, 248, 249, and nucleic acid sequences 100% complementary thereto; hybridizing at least one nucleic acid molecule comprising a contiguous sequence at least 9 nucleotides in length that is 100% complementary to, or hybridizes under stringent conditions to a sequence selected from the group consisting of SEQ ID NO: 130, 131, 248, 249, and nucleic acid sequences 100% complementary thereto, and extending at least one such hybridized nucleic acid molecule by at least one nucleotide base; and sequencing in e) of the amplificate.

13. The method of claim 5, comprising in d) amplification by primer oligonucleotides comprising one or more CpG; TpG or CpA dinucleotides and further comprising in e) hybridizing at least one detectably labeled nucleic acid molecule comprising a contiguous sequence at least 9 nucleotides in length that is 100% complementary to, or hybridizes under stringent conditions to a sequence selected from the group consisting of SEQ ID NO: 130, 131, 248, 249.

14. The method of claim 5, comprising in d) the use of at least one nucleic acid molecule or peptide nucleic acid molecule comprising in each case a contiguous sequence at least 9 nucleotides in length that is 100% complementary to, or hybridizes under stringent conditions to a sequence selected from the group consisting of SEQ ID NO: 130, 131, 248, 249, and nucleic acid sequences 100% complementary thereto, wherein said nucleic acid molecule or peptide nucleic acid molecule suppresses amplification of the nucleic acid to which it is hybridized, and further comprising in e) hybridizing at least one detectably labeled nucleic acid molecule comprising a contiguous sequence at least 9 nucleotides in length that is 100% complementary to, or hybridizes under stringent conditions to a sequence selected from the group consisting of SEQ ID NO: 130, 131, 248, 249.

15. A method for analyzing methylation status in a prostate sample in a subject, comprising:
a) obtaining, from the subject, a biological sample having prostate genomic DNA; b) isolating the genomic DNA; c) contacting Histone H4 genomic DNA as set forth in SEQ ID NO: 36, and sequences that hybridize under stringent conditions thereto, in the DNA isolated in b) with one or more methylation-sensitive restriction enzymes, wherein the genomic DNA is, with respect to each cleavage recognition motif thereof, either cleaved thereby to produce cleavage fragments, or not cleaved thereby; and
d) determining, based on a presence or absence of, or on property of at least one such cleavage fragment, the methylation state of at least one CpG dinucleotide of SEQ ID NO: 36, or an average, or a value reflecting an average methylation state of a plurality of CpG dinucleotides of SEQ ID NO: 36.

16. The method of claim 15, further comprising, prior to determining in d), amplifying of the digested or undigested genomic DNA.

17. The method of claim 16, wherein amplifying comprises use of at least one method selected from the group consisting of: use of a heat resistant DNA polymerase as an amplification enzyme; use of a polymerase lacking 5'-3' exonuclease activity; use of a polymerase chain reaction (PCR); generation of a amplificate nucleic acid carrying a detectable label; and combinations thereof.

18. The method of claim 17, wherein the detectable amplificate label is selected from the label group consisting of: fluorescent labels; radionuclides or radiolabels; amplificate mass labels detectable in a mass spectrometer; detachable amplificate fragment mass labels detectable in a mass spectrometer; amplificate, and detachable amplificate fragment mass labels having a single-positive or single-negative net charge detectable in a mass spectrometer; and combinations thereof.

19. The method of claim 15, wherein the biological sample obtained from the subject is selected from the group consisting of cell lines, histological slides, biopsies, paraffin-embedded tissue, bodily fluids, ejaculate, urine, blood, and combinations thereof.

20. The method of claim 1, wherein prostate cancer, prostate carcinoma or prostate neoplasm is detected or distinguished.

\* \* \* \* \*